(12) United States Patent
Querbes et al.

(10) Patent No.: US 10,478,500 B2
(45) Date of Patent: Nov. 19, 2019

(54) COMPOSITIONS AND METHODS FOR INHIBITION OF HAO1 (HYDROXYACID OXIDASE 1 (GLYCOLATE OXIDASE)) GENE EXPRESSION

(71) Applicant: Alnylam Pharmaceuticals, Inc., Cambridge, MA (US)

(72) Inventors: William Querbes, Boston, MA (US); Kevin Fitzgerald, Brookline, MA (US); Brian Bettencourt, Groton, MA (US); Abigail Liebow, Somerville, MA (US); David V. Erbe, Arlington, MA (US)

(73) Assignee: Alnylam Pharmaceuticals, Inc., Cambridge, MA (US)

( * ) Notice: Subject to any disclaimer, the term of this patent is extended or adjusted under 35 U.S.C. 154(b) by 0 days.

(21) Appl. No.: 15/517,471

(22) PCT Filed: Oct. 9, 2015

(86) PCT No.: PCT/US2015/054881
§ 371 (c)(1),
(2) Date: Apr. 6, 2017

(87) PCT Pub. No.: WO2016/057893
PCT Pub. Date: Apr. 14, 2016

(65) Prior Publication Data
US 2017/0304446 A1    Oct. 26, 2017

Related U.S. Application Data

(60) Provisional application No. 62/062,751, filed on Oct. 10, 2014, provisional application No. 62/147,976, filed on Apr. 15, 2015, provisional application No. 62/214,602, filed on Sep. 4, 2015.

(51) Int. Cl.
| | | |
|---|---|---|
| *A61K 48/00* | (2006.01) | |
| *C07H 21/02* | (2006.01) | |
| *C07H 21/04* | (2006.01) | |
| *A61K 45/06* | (2006.01) | |
| *A61K 47/54* | (2017.01) | |
| *A61K 31/713* | (2006.01) | |
| *C12N 15/113* | (2010.01) | |
| *A61K 31/00* | (2006.01) | |
| *A61K 45/00* | (2006.01) | |

(52) U.S. Cl.
CPC ............ *A61K 45/06* (2013.01); *A61K 31/713* (2013.01); *A61K 47/549* (2017.08); *C12N 15/1137* (2013.01); *A61K 31/00* (2013.01); *A61K 45/00* (2013.01); *C12N 2310/14* (2013.01); *C12N 2310/315* (2013.01); *C12N 2310/344* (2013.01); *C12N 2310/346* (2013.01); *C12N 2310/351* (2013.01); *C12N 2310/3515* (2013.01); *C12Y 101/03015* (2013.01)

(58) Field of Classification Search
CPC ..... C12N 15/111; C12N 15/113; A61K 31/713
See application file for complete search history.

(56) References Cited

U.S. PATENT DOCUMENTS

| | | | |
|---|---|---|---|
| 7,427,605 B2 | 9/2008 | Davis et al. | |
| 7,718,629 B2 | 5/2010 | Bumcrot et al. | |
| 8,106,022 B2 | 1/2012 | Manoharan et al. | |
| 8,268,986 B2 * | 9/2012 | Beigelman ........... | A61K 47/554 536/23.1 |
| 9,701,966 B2 | 7/2017 | Brown et al. | |
| 9,879,266 B2 | 1/2018 | Khvorova et al. | |
| 2003/0143732 A1 | 7/2003 | Fosnaugh et al. | |
| 2003/0170891 A1 | 9/2003 | McSwiggen | |
| 2004/0259247 A1 | 12/2004 | Tuschl et al. | |
| 2005/0176025 A1 | 8/2005 | McSwiggen et al. | |
| 2006/0263435 A1 | 11/2006 | Davis et al. | |
| 2007/0004664 A1 | 1/2007 | McSwiggen et al. | |
| 2007/0031844 A1 | 2/2007 | Khvorova et al. | |
| 2007/0259352 A1 * | 11/2007 | Bentwich ........... | C07K 14/4748 435/6.14 |
| 2007/0281899 A1 | 12/2007 | Bumcrot et al. | |
| 2009/0149403 A1 | 6/2009 | MacLachlan | |
| 2011/0015250 A1 | 1/2011 | Bumcrot et al. | |
| 2011/0287974 A1 | 11/2011 | Benvenisty et al. | |

(Continued)

FOREIGN PATENT DOCUMENTS

| | | |
|---|---|---|
| WO | WO 2004/080406 | 9/2004 |
| WO | WO 2004/090108 | 10/2004 |
| WO | WO 2010/147992 | 12/2010 |

(Continued)

OTHER PUBLICATIONS

PCT International Search Report Written Opinion for PCT/US2015/054881, dated Feb. 16, 2016, 19 Pages.

(Continued)

*Primary Examiner* — Amy H Bowman
(74) *Attorney, Agent, or Firm* — Goodwin Procter LLP

(57) ABSTRACT

The invention relates to RNAi agents, e.g. double-stranded RNAi agents, targeting the HAO1 gene, and method of using such RNAi agents to inhibit expression of HAO1 and methods of treating subjects having, e.g., PH1. Described herein are double-stranded RNAi agents which inhibit the expression of a HA01 gene in a cell, such as a cell within a subject, e.g., a mammal, such as a human having a HAO1 associated disorder, and uses of such double-stranded RNAi agents. In certain aspects of the invention, substantially all of the nucleotides of an iRNA of the invention are modified.

19 Claims, 30 Drawing Sheets

Specification includes a Sequence Listing.

(56) References Cited

U.S. PATENT DOCUMENTS

| | | | |
|---|---|---|---|
| 2011/0301229 A1 | 12/2011 | Rossi et al. | |
| 2012/0244207 A1 | 9/2012 | Fitzgerald et al. | |
| 2013/0245091 A1* | 9/2013 | Rozema | A61K 9/08 514/44 A |
| 2014/0221465 A1 | 8/2014 | Bancel et al. | |
| 2014/0288158 A1 | 9/2014 | Rajeev et al. | |
| 2015/0184160 A1* | 7/2015 | Brown | C12N 9/0006 514/44 A |
| 2016/0201065 A1 | 7/2016 | Khvorova et al. | |

FOREIGN PATENT DOCUMENTS

| | | |
|---|---|---|
| WO | WO 2012023960 | 2/2012 |
| WO | WO 2013/075035 A1 | 5/2013 |
| WO | WO 2013074974 | 5/2013 |
| WO | WO 2014/025805 | 2/2014 |
| WO | WO 2014/160129 A2 | 10/2014 |
| WO | WO 2015/100436 A1 | 7/2015 |
| WO | WO 2016/205323 A1 | 12/2016 |

OTHER PUBLICATIONS

PCT Invitation to Additional Fees and, where Applicable, Protest Fee, PCT/US2015/054881, dated Dec. 16, 2015, 3 Pages.
Agrawal, S., et al., "Antisense oligonucleotides: towards clinical trials." Trends in Biotechnology. Oct. 1996, vol. 14, pp. 376-387.
Bass, B., "The short answer," Nature, May 24, 2001, pp. 428-429, vol. 411.
Elbashir, S., et al., "Analysis of gene function in somatic mammalian cells using small interfering RNAs," Methods, 2002, pp. 199-213, vol. 26.
Elbashir, S., et al., "Duplexes of 21-nucleotide RNAs mediate RNA interference in mammalian cell culture," Nature, May 24, 2001, p. 494-498, vol. 411.
Elbashir, S., et al., "Functional Anatomy of siRNAs for Mediating Efficient RNAi in Drosophila Melanogaster Embryo Lysate", The EMBO Journal, 2001, pp. 6877-6888, vol. 20, No. 23.
Elbashir, S., et al., "RNA Interference is Mediated by 21 -and 22 Nucleotide RNAs," Genes & Development, 2001, pp. 188-200, vol. 15.
Fire, A., "RNA-triggered Gene Silencing," Trends in Genetics, Sep. 1999, pp. 358-363, vol. 15, No. 9.
Fire, A., et al., "Potent and Specific Genetic Interference by Double Stranded RNA in Caenorhabditis elegans," Nature, Feb. 19, 1998, pp. 806-811, vol. 391.
Hornung, V., et al., "Sequence-specific potent induction of IFN-α by short interfering RNA in plasmacytoid dendritic cells throughTLR7," Nature Medicine, Mar. 2005, pp. 263-270, vol. 11, No. 3.
Reynolds, et al. (2004) "Rational siRNA design for RNA interference," Nature Biotechnology, vol. 22, No. 3, pp. 326-330.
Robbins, M., et al., "Stable expression of shRNAs in human CD34⁺progenitor cells can avoid induction of interferon responses to siRNAs in vitro," Nature Biotechnology, May 2006, pp. 566-571, vol. 24, No. 5.
Rose, S., et al., "Functional polarity is introduced by Dicer processing of short substrate RNAs," Nucleic Acids Research, 2005, pp. 4140-4156, vol. 33, No. 13.
Tuschl, T., "Functional genomics: RNA sets the standard," Nature, Jan. 16, 2003, vol. 421, No. 6920, pp. 220-221.
Tuschl T., "RNA Interference and Small Interfering RNAs" Chembiochem, 2001, pp. 239-245, vol. 2.
Tuschl, T., et al., "Small Interfering RNAs: A Revolutionary Tool for the Analysis of Gene Function and Gene Therapy," Molecular Interventions, 2002, pp. 158-167, vol. 2, No. 3.
Tuschl, T., "Mammalian RNA Interference," RNAi, A Guide to Gene Silencing, Chapter 13, G.J. Hannon (ed,), 2003, pp. 265-295.
Tuschl, T., et al., "Targeted mRNA Degradation by Double-Stranded RNA in Vitro," Genes & Development, 1999, pp. 3191-3197, vol. 13.
Tuschl, T., "Expanding small RNA interference," Nature Biotechnology, May 2002, pp. 446-448, vol. 20.
Vickers, T., et al., "Efficient Reduction of Target RNAs by Small Interfering RNA and Rnase H-dependent Antisense Agents," The Journal of Biological Chemistry, Feb. 28, 2003, pp. 7108-7118, vol. 278, No. 9.
Weil, et al (2002) "Targeting the Kinesin Eg5 to Monitor siRNA Transfection in Mammalian Cells," *Biotechniques* 33(6):1244-1248.
Zimmerman, et al. (2006) "RNAi-mediated gene silencing in non-human primates," *Nature*, vol. 441, May 4:111-114.
Baker, L., et al., "Effects of mechanical uncouplers, diacetyl monoxime, and cytochalasin-D on the electrophysiology of perfused mouse hearts," American Journal of Physiology—Heart and Circulatory Physiology, Jun. 10, 2004, pp. H1771-H1779, vol. 287 No. 4.
Chern, M., et al., "Reduced expression of glycolate oxidase leads to enhanced disease resistance in rice," PeerJ, Feb. 12, 2013, pp. 1-16.
Cochat, P., et al., "Primary Hyperoxaluria," Medical Progress, the New England Journal of Medicine, Review Article, Aug. 15, 2013, pp. 649-658, vol. 369, No. 7.
Dicerna Pharmaceuticals, Inc., Securities and Exchange Commission filing on Dec. 31, 2013, 180 Pages.
Knight, J., et al., "Glycolate and 2-phosphoglycolate content of tissues measured by ion chromatography coupled to mass spectrometry," Analytical Biochemistry, 2012, vol. 421, pp. 121-124.
Liebow, A., et al., "An Investigational RNAi Therapeutic Targeting Glycolate Oxidase Reduces Oxalate Production in Models of Primary Hyperoxaluria," Journal of the American Society of Nephrology, Mar. 22, 2016, pp. 1-10.
Pey, A., et al., "Protein Homeostasis Defects of Alanine-Glyoxylate Aminotransferase: New Therapeutic Strategies in Primary Hyperoxaluria Type I," BioMed Research International vol. 2013, Article ID 687658, 2013, 15 pages.
Salido, E., et al., "Alanine-glyoxylate aminotransferase-deficient mice, a model for primary hyperoxaluria that responds to adenoviral gene transfer," PNAS, Nov. 28, 2006, pp. 18249-18254, vol. 103, No. 48.
Examination Report for the Arab States of the Gulf GCC Patent Office, Patent Application No. GC 2015-30175, dated Jan. 23, 2018, 6 Pages.
Extended European Search Report for European Patent Application No. EP 15848512.8, dated May 17, 2018, 9 Pages.
Salido, E., et al: "Primary hyperoxalurias: Disorders of glyoxylate detoxification", Biochimica Et Biophysica Acta. Molecular Basis of Disease, Mar. 6, 2012, vol. 1822, No. 9, pp. 1453-1464.

* cited by examiner (SEQ ID NO:1).
>gi|111184232|ref|NM_017545.2| Homo sapiens hydroxyacid oxidase (glycolate oxidase) 1 (HAO1), mRNA
CTGGGATAGCAATAACCTGTGAAAATGCTCCCCCGCTAATTTGTATCAATGATTATGAACAACATGCTA
AATCAGTACTTCCAAAGTCTATATATGACTATTACAGGTCTGGGGCAAATGATGAAGAAACTTTGGCTGA
TAATATTGCAGCATTTTCCAGATGGAAGCTGTATCCAAGGATGCTCCGGAATGTTGTGAAACAGATCTG
TCGACTTCTGTTTTAGGACAGAGGGTCAGCATGCCAATATGTGTGGGGGCTACGGCCATGCAGCGCATGG
CTCATGTGGACGGCGAGCTTGCCACTGTGAGAGCCTGTCAGTCCCTGAGCGCATGGGAACGGGCATGATGTTGAGTTC
CTGGGCCACCTCCTCAATTGAAGAAGTGGCGGAAGCTGGTCCTGAAGCCACTTCGTTGGCTGCAACTGTAT
ATCTACAAGGACCGAGAAGTCACCAAGAAGCTAGTGCGGCAAGAGATGGGCTACAAGGCCATAT
TTGTGACAGTGGACACACCTTACCTGGACGTCTGGACAACCGTCTGCGTAACAGATTCAAACTGCCGCC
ACAACTCAGGATGAAAAATTTGAAACCAGTACTTTATCATTTTCTCGAGGAAAATTTGGAGACGAC
AGTGGACTTGCTGCATATGTGGCTAAAGCAATAGACCCATCTATCAGCTGGAAGATATCAAATGGCTGA
GAAGACTGACATCATTGCAATTGTTGTCAGAGCATTTTGAGAGGTGATGATGCCAGGGAGGCTGTTAA
ACATGGCTTGAATGGGATCTTGGTGTCGAATCATGGGGCTCGACAACTCGATGGGGTGCCAGCCACTATT
GATGTTCTGCCAGAAATTGTGAGGCTGTGTGGAGGCTCTGGCCTCGCGCCAAGGTCTTCCTGACGGGTGTGCCGA
AAGGCACTGATGTTCTGAAAGCTCTCGCTTCGGCGCCAAGCTGTGTTGTGGGGAGACCAATCGTTTG
GGGCTTAGCTTCCAGGGGGAGAAAGGTGTCAAGATGTCCTCGAGATACTAAAGGAAGAATTCCGGTTG
GCCATGGCTCTGAGTGGGTGCCAGAAGTGAAAGTCATCGACAAGACATTGGTGAGGAAAAATCCTTTGG
CCGTTTCCAAGATCTGAGTGGGTGCCAGAAGTGAAAGTCATCGACAAGACATTGGTGAGGAAAAATCCTTTG
ACAAAGAGACACTGTGCAGAGGGTGACCACAGTCTGTAATTCCCCACTTCAATACAAAGGGTGTCGTTCT
TTTCCAACAAAATAGCAATCCCTTTATTCATTGCTTTTGACTTTTCAATGGGTGTCCTAGGAACCTTT
TAGAAAGAAATGGACTTTCATCCTGGAAATATATTAACTGTTAAAAGAAAACATTGAAAATGTGTTTAG
ACAACGTCATCCCCTGCAGGCTAAAGTGCTGTATCCTTTAGTAAATTGGAGGTAGCAAACACTAAGGT
GAAAAGATAATGATCTCATTGTTATTAACCTGTATTCTGTTTACATGTCTTTTAAAACAGTGGTTCTTAA
ATTGTAAGCTCAGTTCAAAGTTGGTAATGCCTGATTCACAACTTTGAGAAGGTAGCACTGGAGAGAA
TTGGAATGGGTGGCGTAATTGGTGATACTTCTTTGAATGTAGATTTCCAATCACATCTTTAGTGTCTGA
ATATATCCAAATGTTTTAGGATGTATGTTACTTCTTAGAGAGAAATAAAGCATTTTTGGGAAGAAT

FIG. 1

(SEQ ID NO:2)
>gi|133893166|ref|NM_010403.2| Mus musculus hydroxyacid oxidase 1, liver (Hao1), mRNA
GGTTGCCCTACCCTGCCACAATGTTGCCTCGACTGGTCTGCATCAGTGATTATGAACAGCATGTCCGATC
AGTGCTTCAGAAGTCAGTGTATGACTATTACAGGTCTCGGGCAAATGATCAGAGACGTTAGCTGATAAC
ATCCAAGCATTTCTAGACAGAGAGTCAGCATGCCAATATGTGTTGGGCTACTGCCATGCAGTGCATGGCTCA
CTTCTGTTTTAGGACAGAGAGTCAGCATGCCGAGCATGGCCAGACCATGGAACTGGAACTGGATGCTGAGTTCTTGG
CGTGGACGGGGAGCTGGCCACTGTGCGAGCATGGCCAGAAGTGGCAGAAGCTGGCCCAGAGCGAGCTGAGAAGCAGGCACTTCGCTGGATGCAACTGTACATCT
GCTACCTCCTCAATAGAAGAAGTGGCAGACAGATAGTGAAGCTGAAGCAGCTGAGAAGCAGGTTACAAGGCCATATTTGT
ACAAAGACCGTGAGATCAGCAGACAGATAGTGAAGCTGAAGCAGCTGAGAAGCAGGTTACAAGGCCATATTTGT
GACTGTGGACACCCCTTACCTGGGCAACCGCATTGATGACGTGCGGAACAGTTCAAGCTGCCACCACAA
CTCAGGATGAAAAAACTTTGAAACCAATGATTTGGCATTTCTCCTAAGGAAATTTTGGAGACAACAGTG
GACTTGCTGAATATGTGGCACAAGCTATAGACCCATCTGCAGCTGGGATGATATTACATGGCTCAGACG
ATTGACATCACTGCCTATTGTTGTGTAAAGGGCATTTGGGGCGACAACTGGATGGGGTGCCAGCTACTATTGATG
GGTGTGGATGGGATCTTGGTGTCGAATCATGGGGCGAAGGTAGAAGTCTTCCTGATGGGGAGTAAGGAAAGG
TCCTGCCAGAGATTGTTGAGGCTGTGTGAAGCCTCGGCCCTAGGAGCCAAGGCCGTTTTTGTGGGAAGACCCATCATCTGGGGC
TACTGATGTTCTCAAAGCTCTGGCCCTAGGAGCCAAGGCCGTTTTTGTGGGAAGACCCATCATCTGGGGC
TTGGCTTTCCAGGGGGAGAAAGGTTTCAAGATGTCCTCGAGATATTGAAGGAAGAATTCCGACTGGCCA
TGGCTCTCGAGTGGGTGCCAGAATGTGAAAGTCATCGACAAGACATTGGTGAGGAAAATCCTTTGGCTGT
TTCCAAGATCTGACAGTGCACAATATTTTCCCACTCTGTATTATTTTTTTTCCAGCCGTCGATTACTTGACA
AAGAGACACTGTGCAGAGGGTGACCACAGACTGTAACTCCCCACTTCTATACAAAGGGTGTCGTTCTTTT
CCAACAAAATAGCCACCCCTTTTCCTTCATTGCTTTTGACTTTTCAATGGGTGTCCTAGGAACCTTCTAG
AAAGAAATGGACTTGCATCCTGCAGGCTAAAGTGCTGGGAACAAAAGATATCCTCTGGTGAGATTGCAGGTAGCATG
ACGTCATCCCCTGGCAGGCTAAAGTGCTGGGAACAAAAGATATCCTCTGGTGAGATTGCAGGTAGCATG
CTGAAGTGAAAGATACTGACCTCACTGTTCATTAACCTGTCTTCTTCTGTTTAGATTTCCTTAAGACAGTGGC
TCTTACAGTTGCACTTGGCTTTGAAATGCTGAAATGCTGGAAATGCCCAGAGAAACATGAGGTTTGGATTTGCCATG
TTGAGAAAATAGCACCAGGTAGAATTGAAATGATGGTGTAATTTGTGATTTTTTTTCTAGAAACTTTT
CATTTTTTTAACACCCTATTTTTTGAAGGTAGATTTTTAGCTATATATCACACGTCTGAATATGTCTGAA
TGTTTTGTGGCACTCATTGCATTTGAAAGGGATGTGTCTAGTCCAGTTGGGACCACATGGAGCTATTTTT
ACTTTTGAACTTTGTCTCCTCATTCTCATTTATAGTCACATTCAGTGAAGTACATATTTTGTGGGTCCGTGA
TTTGATTTTCTCACTTTGAAATTCTGTTCAGAAGGAGGCAAAAAAAAAAAAAAAAGTCTTTCCTTTATCACA
TGAATAAAGATTTGAAATTCTGTTCAGAAGGAGGCAAAAAAAAAAAAAAAAGTCTTTCCTTTATCACA

FIG. 2

(SEQ ID NO:3)
ATTCTTCCCAAAAATGCTTTATTTCTCTCTAAGAAGTAACATACATCCTAAAACATTTGGATATATTCAGACACTAAAGA
TGTGATTGGAAATCTACATTCAAAGAAGTATCACCAATTACCGCCACCCATTCCAATTCTCTCCAGTGCTACCTTCTCAA
AGTTGTGAATCAGGCATTACCAACACTTTGAACCTGAGCTTACAATTTAAGAACCACTGTTTTAAAGACATGTAAACAGA
ATACAGGTTAATAAACAATGAGATCATTATCTTTCACCTTAGTGTTTGCTACCTCCAATTTACTAAGGATACAGCAC
TTTAGCCTGCCAGGGATGACGTTGTCTAAACACATTTCAATGTTTCTTTTTAACAGTAATATATTCCAGGATGAA
AGTCCATTCTTTCTAAAAGGTTCCTAGGACACCCATTGAAAAGTCAAAAGCAATGAAAATAAAAGGATTGCTATTTGT
TGGAAAAGAACGACACCCTTTGTATTGAAGTGGGGAATTACAGACTGTGGTCACCCTCTGCACAGTGTCTCTTTGTCAAG
TAATACATGCTGAAAAAAAATAATACAGATGGGAAAATATTGTGCACTGTCAGATCTTGGAAACGGCCAAAGGATTTTC
CTCACCAATGTCTTGTCGATGACTTTCACATTCTGGCACCCACTCAGAGCCATGGCCAACCGGAATTCTTCCTTTAGTAT
CTCGAGGACATCTTGAACACCTTTCTCCCCCTGGAAAGCTAAGCCCACAAACGATTGGTCTCCCCACAAACACAGCCTTGG
CGCCAAGACCAGAGCTTTCAGAACATCAGTGCCTTTCCGCACACCCCGTCCAGGAAGACTTCCACCTTCCCTTCCACA
GCCTCCACAATTTCTGGCAGAGTTAACAGCCTCCCTGGCATCATCACCTCTCAAAATGCCCTTTGCAACAATTGGCAACACCAAGAT
CCCATTCAAGCCATGTTCAGCCATTTGATATCTTCCCAGCTGATAAAGTACTGGTTTCAAAATTTTCATCCTGAGTTGTGGCGCAGTTTGAA
GTCTTCTCAGCCATTTGATATCTTCCCAGCTGATAAAGTACTGGTTTCAAAATTTTCATCCTGAGTTGTGGCGCAGTTTGAA
TCTCCAAAATTTTCCTCAGGAGAAATGATAAAGTACTGGTTTCAAAATTTTCATCCTGAGTTGTGCGGCAGTTTGAA
TCTGTTACGCCACATCATCCAGACGGTTGCCCAGGTAAGGTGTCTCCTTGTAGATATACAGTTGCAGCCAACGAAGTGCCTCAGGACCA
CTGCCCTGCCGCCACTTCTTCAATTGAGGAGGTGGCCATGAGCGCTGCAACATTCCGGAGCATCCGGAGCCTGACGCTGACCCTCTGTC
GCTTCCGCGCCAAGCTCGCCGTCTGTTTCAGCAACATTCGCGAGCATCCGGAGCCTGACGCTGACCCTCTGTC
AGTGGCAAGCTGCTCACAGTCGACAGATCTGTTTCAGCAACATTCCGGACCTGTAATAGTCATATATAGACTTTGGAAGTACTGATTAGC
CTAAAACAGAAGTGCAAAGTTTCTTCATCATTTGCCCCAGACCTGTAATAGTCATATATAGACTTTGGAAGTACTGATTAGC
ATATTATCAGCCAAAGTTTCTTCATCATTGATACAAATTAGCCGGGGAGCATTTTCACAGGTTATTGCTATCCCAG
ATGTTGTTCATAATCATTGATACAAATTAGCCGGGGAGCATTTTCACAGGTTATTGCTATCCCAG

FIG. 7

(SEQ ID NO:4)
TGTGATAAAGGAAAGACTTTTTTTTTTTTGCCTTCCTTCCTTCTGAACAAGAATTTCAAATCTTTATTCATCACGGACCCCACAAAATATGTACTTTAC
ACTGAATGTGACTATAATGAGGAAAGTGAGGAAATCAAGAGGAATTCAAGAGAAGTCAACACTTATTTTAAAATGAGAATGAGGAGAC
AAAGTTCAAAAGTAAAAATAGCTCCATGTGGTCCCAACTGGACTAGACACATCCCTTTCAAATGCCACAAAACATCCAGACATATTCAG
ACGTGTGATATATAGCTAAAAATCTACCTTCAAAAATAGGGTGTTAAAAATGAAAAGTTTCTAGAAAAATCACAAATTACCACCATCCATTT
CAATTCTACCTGGTGCTATTTTCTCAACATGGCAAATCCAAACCTCATGTTTCTCTGGGCATTTCAAAGCCAAGTGCAAACTGTAAGAG
CCACTGTCTTAAGGAAATCTAAACAGAAGACAGGTTAATGAACAGTGAGGTCAGTATCTTTCACTTCAGCATGCAATCTTCACCAGAGGATA
TCTTTTGTTCCCCAGCACTTAGCCTGCCAGGGGATGACGTTGCCCAAACACATTTTCAATGTTTTCTTTTTAACAGTTAATATATTTCCAGGATGCA
AGTCCATTTCTTTCTAGAAGGTTCCTAGGACACCCATTGAGAAAGCAAAAGCAATGAGGAAAAGGGTGGCTATTTTGTTGGAAAAGAACGACACCC
TTTGTATAGAAGTGGGAGTTACAGTCTGTGGTCACCCTCTGCACAGTGTCTCTCTTTGTCAAGTAATCTGGCACCGCTGAAAAATAATACAGATGGGAA
AATATTGTGCACTGTCAGATCTTGGAAACAGCCAAAGGATTTTTCCTCACCAATGTCTTGTCGAAAAGTCTTGTCGATGACTTTCACATTCTGGCACCCACTCAGAGCCAT
GGCCAGTCGGAATTCTTCCTTCAGAGCTCCTAGGGCCAGAGCATATCTCGAGGACATCAGTAGTATCTCGAGAAGCCAAGCCCCAGATGATGGGTCTTCCCACAGCCTCAACA
CGGCCTTGGCTCCTAGGGCAGGACATCAATAGTAGCTGGCACCCCAGTTGTCGCGCCCAGTGATTGTCGCGCCCATCACACACCATGTTTAACAGCTTC
ATCTGGCATCATCACCCTCAAAATGCCCTTTACAACAATAGGCAGTGATGTCAATGCTCTGAGCCATGTAATATCATCCAGCTGAGAGATGGGTCTA
CTTGGCATCATCACCCTCAAAATGCCCTTTACAACAATAGGCAGTGATGTCAATGCTCTGAGCCATGTAATATCATTGGTTTCAAAGTTTTTCATCCTGAGT
TAGCTTGTGCCACATATTCAGCAAGTCCACTGTTGTCTCCAAAATTCCCTTAGGAGAAATGCCAAATCATTGGTTTCAAAGTTTTTCATCCTGAGT
TGTGGTGGCAGCTGAACCTGTTCCGCACGTCATCAATGCGGTTGCCCAGGTAAGCGGTTGTCCAGCGAAGTGCATCCAGCGAAGTGCCTCTGGGCCAGCTTCTGCCACTTCTTCTA
AGCTCGCTTCACTACTGTCTGCTGAACTCAGCATCATGCCAGTTCCCATGTCCGACAGTCCCCATGGTCGACAGTGGCCAGCTCGACAGCTCCCGTCCCCGTCACGTGAGCCATGCACTGC
TTGAGGAGGTAGCCCAACACATATTGGCATGCCAGTTCCCATGTCCTAAAACAGAAGTTGACAGATCGATATCAGCAACGTTGCGAAGCATCCGTGATA
ATGGCAGTAGCCCAACACATATTGGCATGCCAGTTCCCATGTCCTAAAACAGAAGTTGACAGATCGATATCAGCAACGTTGCGAAGCATCCGTGATA
GAGCTTCCATCTAGAAAATGCTTGGATGTTATCAGCTAACGTCTCCTGATCATTTGCCCAGACCTGTAATAGTCATACACTGACTTCTGAAGCACTG
ATCGGACATGCTGTTCATAATCACTGATGCAGAGACCAGTCGAGGCAACATTGTGGCAGGGTAGGGCAACC

FIG. 8

(SEQ ID NO:5).
>gi|544464345|ref|XM_005568381.1| PREDICTED: Macaca fascicularis hydroxyacid oxidase (glycolate oxidase) 1 (HAO1), mRNA GTGAGGATGTAGAAAGCAATACATTAAAAAACCCAAAAAACTCCATCTGGATAACAATAACCTGTGA
AAATGCTCCCCGGCTAATTTGTATCAATGATTATGAACAACATGCTAAATCAGTACTTCCAAAGTCTAT
ATATGACTATTATAGTCTGGAGCAAATGATGAAGAAACTTTGCCGATAATGTTGCAGCATTTTCCAGA
TGGAAGCTGTATCCAAGGATGCTCCGGAATGTTGCTGAAACAGATCTGTCGACTTCTGTTTTAGGACAGA
GGGTCAGCATGCCAATATGCGTGGGGGCCACGCCAGCGCCATGTCAGCGCTCATGTGGATGGCGAGCTTGC
CACTGTGCCGAGCCTGTCAGTCCCTGGGAACGGGCATGATGTTGAGTTCCTGGGCCACCTCCTCAATGAA
GAAGTGGCAGAAGCTGGTCCTGCAGCAGGCAGAGAACGGGCTACAAGGCTACGTAACAGATTCAAGCTGCCACCAATCCAGATGAAAAATTTT
CCTGGGCAACCGTCTTGATGATGTACGTAACAGATTCAAGCTGCCACCAACTGCTGGACTTGTGACAGTGGACACACCTTA
GAAACCAGTACTACTTTATCATTTTCTCCTGAGGAAGTACGTAACAGATATCAAATGCTGAAGAAGACTGGACTTGCCAAT
CTAAAGCGATAGACCCATCTATCAGCTGGGAAGATATCAAATGCTGAAGAAGACTGACGTCATTGCCAAT
TGTTGCAAAGGCATTTTGAGAGGTGATGATGCCAGGAGGCTGTTAAACATGGCTTGAATGGATCTTG
GTGTCGAATCATGGGGCTCGACAACTCGATGGGGTGCCAGCCACTGTGTGCGAAAGCACTGATGTTCTGAAAGC
AGCCCGTGAAGGGAAGGTGGAAGTGCTTCCTGACGCAGGGGTGTGCGAAAGCACTGATGTTCTGAAAGC
TCTGGGCTCTTGGCCGCCAAGGCTGTCCAAGGCTGTCGTTGTGGGAGACCAATCATTGGGCTTAGCTTTCCAGGGGGAG
AAAGGTGTTCAAGATGTCCTTGAGATACTAAAGGAAGAATTCCGGTTGCCATGGCCTTGAGTGGGTGCC
AGAATGTGAAAGTCATCGACAAGACATTGGTGAGGAAAAATCCTTTGGCCGTTTCCAAGATCTGACAGTG
CACAATATTTCCCATCCATCTGTATTATTTTTTTTCAGCATGTATTACTTGACAAAGAGACACTGTGCAGAG
GGTGACCACAGTCTGTAATTCCCCACTTCAATGGGTGTCCTAGGAACCTTTTAGAAAAGAAAATGGACTTTCAT
CTTTTAGTTCATTGCTTTTGACTTTTCAATGGGTGTCCTAGGAACCTTTTAGAAAAGAAAATGGACTTTCAT
CCTGGAAATATATTAACTGTTAAAAGAAACATTGAAAATGTGTTTAGACAACGTCATCCTCCTGGCAGG
CTAAAGTACTGTATCCTTTAGTAAATTGGAGGAGCAAACACTGGTTCTTAAATTGTAAGCTCAGGTTCAAAG
TTTATTAACCTGTATCTGTTTAGATGTCTTTAAAACAGTGGTTCTTCTTAAATTGTAAGCTCAGGTTCAAAG
CATTGAAATGCCTGATTGACAACATTGAGAAGGTAGCCCTGGATAGGATGCCCTGGATGGCAGTAACT
GGTGATACTTCTTTGAATGCAGCTTTCCAATCACATCTTTAGTGTCTGAATATATCCAAATGTTTTAGGA
TATATGTTTACTTCTTAATCAGAGAGAAATAAAGCATTTTTTGGGAAGGATA

FIG. 9

(SEQ ID NO:6).
>gi|564343200|ref|XM_006235096.1| PREDICTED: Rattus norvegicus hydroxyacid oxidase (glycolate oxidase) 1 (Hao1), transcript variant X1, mRNA ATACTGCCTTGCTGGCTTGGAAATTCTAGAGTTTCTGAGGCATAGTAGACTTGGTGACCTCTAACCGAGCAGAAAGAGTCTCATGG
CTTCTGTGACTACTATAGTGGAAGCTCTATCCACGGATGCTGCCAACGTTGCTGATATCGACTTCTGTTTTAGGACAGAGAGTGAGCAT
GCCAATATGCGTTGGGGCTACGGCTATGCAGTGCAGTGCTCATGTGGATGGGGAGCTGGCACCTGTCAGACCATGGGAACTGGCATGA
TGTTGAGTTCCTGGGCCACTTCCTCAATAGAAGAGGTGGCAGAGGCTGGCCGGAGGCACTTGCGTGGATGCAACTCTACATCTACAAAGATCGTGAG
GTCAGCAGTCAGTGGTCTGAAGAGGGCTGAGCAGATGGGTTACAAGGCCATATTTGTGACTGTGGACACCCCTTACCTGGGAAATCGCTTCGATGATGT
GCGGAACAGGTTCAAGCTACCACCACAGCTCAGGATGATGAAAAAACTTGAAACGATTTGGCATTTTCTCCTAAGGGAATTTGGAGACAACAGTG
GCCTTGCTGAATATGTGGCACAAGCCATAGACCCATCTCAGCTGGATGATATTAAATGCTCAGACGGTTGACCTCACTGCCCATTGTTGTAAAG
GAATTTTGAGAGGTGATGATGCCCTGCCAGAGATCGTTGAGGCTGTGTTTTGTGGGGAGACCCATCTGTTAAACATGGTGTGATGGATCTTAGTGTCAAGCTCTTCCTGGCTTTCCAGGGAGTCAGGAAAGTGTTCAAGATGTCCTCGAG
AAGCTCTGCCCTGGGAAGAGTTCCGGCTGGCCACAATATTTCCCATCTGTCGTTCTTTTCCAACAAATAGCCACCCCTTCATTGCTTTTGACTTTTCAATGGGTGTCCT
ATACTGAAGGAAGAGTCGACAGTGCACAGTGCACAATATTTCCCATCTGTCGTTCTTTTCCAACAAATAGCCACCCCTTCATTGCTTTTGACTTTTCAATGGGTGTCCT
TTCCAAGATCTGACAGTGCACAATATTTCCCATCTGTCGTTCTTTTCCAACAAATAGCCACCCCTTCATTGCTTTTGACTTTTCAATGGGTGTCCT
ACTGTAACTCCCCACTTCAACACAACAAAGGGTGTCATCCTGGAAATATAATTAACTGTTAAAAAGAACACTGACCTCACTGTTATTAACCTGTCTT
AGGAACCTTCTAGAAAGAGAAATGACTTTGCATCCTGGAAATATAATTAACTGTTAAAAAGAACACTGACCTCACTGTTATTAACCTGTCTT
AGGCTAAAGTGAGGGGAACAAAAGATATCCTCTGGTGACAGTGTGCGCTGGTAATTTGTGATTTTCTAGAGACTTTTCATTTTCTTGAAGGTGG
CTGTTTAGATTTCCTTAAGACAGTGCCATGGCTCTCTGTCTGTGAATGCTGAATTGTGTTTTCTAGAGACTTTTCATTTTCTTGAAGGTGG
TGAGAAAATAGCACCCGATAGAATTGAAACGATGGTTGGCTGTGTTTTGTGCACTCACTGTGTGACTTCCTAATTCCCCTGAATCATTTTTATTTTCCACTTCTCA
ATTTCTAGCTATATATCGCATGCTCTCGTCTCTTCATTCCCATTTAAAGTAAAGCTTGGACTCCCTAATTCCCTGAATCATTTTTATTTTCCACTTCTCA
AGTTATTTATTTTGAACTCTGCATGCTCTCGTCTCTTCATTCCCATTTAAAGTAAAGCTTGGACTCCCTAATTCCCTGAATCATTTTTATTTTCCACTTCTCA
TTTATAGTCACATTCAGTGTCAAGTATATATATTTGTGGGGTCCATGGTGAATAAAGCTTTAAAATTCTGTCCAGAAA

FIG. 10

(SEQ ID NO:7)
TATCCTTCCAAAAAATGCTTTATTTCTCTCTGATTAAGAAGTAACATATATTCCTAAAACATTTGGATATATATTCAGACACTAAAGATGTGATTGGAA
AGCTGCATTCAAAGAAGTATCACCAGTTACTGCCATCCATTCCAATTCTATCCAGGGCTACCTTCTCAATGTTGTCAATCAGGCATTTCCAATGCTTT
TGAACCTGAGCTTACAATTTAAGAACCACTGTTTTAAAGACATCTAAACAGAATACAGGTTAATAAACAATGAGATCATTATCTTTTCACCTTAGTG
TTTGCTACCTCCAATTTACTAAAGGATACAGTACTTTAGCCTGCCAGAGGATGACGTTGTCTAAACACATTTCAATGTTTCTTTTAACAGTTA
ATATATTCCAGGATGAAAGTCCATTCTTTCTAAAAGGTTCCTAGGACACCCATTGAAAAGTCAAAAGCAATGAACTAAAAGGGATTGCTATTTTG
TTGGAAAAGAACGACATCCTTTGTATTGAAGTGGGGAATTACAGACTGTGGTCACCCTCTGCACAGTGTCTCTTTGTCAAGTAATACATGCTGAAAA
AAAAATAATACAGATGGGAAAATATTGTGCACTGTCAGATCTTGGAAACGGCCAAAGGATTTTCCTCACCAATGTCTTGTGATGACTTTCACATT
CTGGCACCCACTCAAAGCCATGCCAACGGAATTCTTCCTTTAGTATCTCAAGGACATCTCAAGAACATCAGTGCCTTTCCGCACACCTTTCTCCCCCTGGAAAGCTAAGCCCAA
ATGATTGGTCTCCCCACAAACACAGCCTTGGCGCCAAGAGCCAGAGCTTTCAGAACATCAGTGCCTTTCCGCACACCCCGTCCAGAAGACTTCA
CCTTCCCTTCCACGGCCCTCCACAATTTCTGGCAGAACATCAATAGTGGCTGGCACCCCATCGAGTTGTCGAGCCCATGATTCGACACCAAGATCCC
ATTCAAGCCATGTTTAACAGCCTCCCTGGCATCATCACCTCTCAAAATGCCCTTTGCAACAATTGGCAAATTTCCTCAGGAGAAATGATAAAGTAC
TCTTCCCAGCTGATAGATGGTCTATCGCTGCTTTAGCCACCACATGCCAAGTCATCTCAAGACGGTTACGTAACATCATCAAGACGGTAAGGTGTGTCCACTGTCAC
TGGTTCAAAATTTTCATCCGAGTTGTGGTGCCAGCTTGAATCTGTTACGTAACATCATCAAGACGGTTACGTAACATCATCAACGAAGTGCC
AAATATGGCCTTGTAGCCCGTCTTCTCTGCCAGTTCTCTGGTGACTTCTCGGTCCTATAGATATACAGTTACAACCAACGAAGTGCC
TCAGGACCAGCTTCTGCCACTTCTGCCATGCCATGCTGCATCAATGAGGAGGTGGCCAGCGCCGTGACCCTCTGTCCTAAAACAGAAGTGACAGATCTGT
GCTCGCCATCCACATGAGCCATGCTGCTGTTGGATATACAGCTTCCATCTGGAAAATGCTGCAACATTATCGGCCAAAGTTTCTTCATCATTTGCTCCAGACCTA
TAATAGTCATATATAGACTTTGGAAGTACTGATTAGCATGTTGTTCATAATCATTGATACAAATTAGCCGGGGAGCATTTCACAGTTATTGTT
ATCCCAGATGGAGTTTTTTGGGTTTTTTTAATGTATTGCTTTCTACATCCCTCAC

(SEQ ID NO:8)
TTCTGGACAAGAATTTTAAAGCTTTATTCACCATGGACCCCACAAATATATACTTGACACTGAATGTGACTATAAATGAGAAGTGAGAAATAA
AAATGATTCAAGGGGAATTAGGAAGTCAACACTTACTTTAAAATGGAATGAAGAGACAGAGTTCAAAATAAAATAACTTTGCATGGTCCCAAGT
GGACTAGACACATTCCTTTCAAACACAGTGAGTGCCACAAAACAGCCAGACATATTCAGACATGCGATATAGCTAGAAATCCACCTTCAAAGAA
ATAGGGTGTTAAAAATGAAAAGTCTCTAGAAAATCACAAATTACCACCATCCGTTTCAATTCAAGGGTGCTATTTTCTCAACACGGCAAATC
CAAACCCATGTTCTCTGGGCATTTCAAAGCCCAGCCACACTGTCTTAAGGACCACTCTATCGGGTGCTATTTTCTCAACACGGCAAATC
AATAAACAGTGAGGTCAGTGTCTTTTACTTCGGCATGCTACCTCCAATCTCACCAGAGATATCTTTTGTTCCCCTCACTTTAGCCTGCCAGGGG
ATGACGTTGCCCAAACACATTTCAATGTTTTCTTTTTAACAGTTAATATATTTCCAGGATGCAAGTCCATTTCTTTCTAGAAGGTTCCTAGGACA
CCCATTGAAAAGTCAAAAGCAATGAAGGAGAAGGGGTGGCTATTTTGTTGGAAAAAAATAATACAGATGGGAAAATATTGTGCACTGTCAGATCTTGAAAC
GGTCACCCTCTGCACAGTGTCTCTCTTTGTCAAGTAATCCATGCTGATGACTTTCACATTCTGGCACCCACTCAGAGCCATGGCCAGCCGGAACTCTTCCTTCAGTAT
AGCCAAAGGATTTTCCTCAACATGTCTGTCCCCCTGGAAAGCCAAGCCCCCAGATGATGGGTCTCCCCACAAAACAGCTCTGGCTCCCAGGGCCAGAGC
CTCGAGGACATCTTGAACACCTTTCTCCCCTGACTCCCCCATCCAGGAAGACTTCTACCTTCCCTTCCACACCATGTTTAACAGCTTCTGCAGGGCATCAATAGT
TTTGAGAACATCGGTGCCTTGCCATCCAGTGTCGTGCCCAGTGAGTCAACCGTCTGAGCCATTAATATCATCCCAGCTGAGATGGGTCTATGCTTGTGCCACATATTC
AATTCCCTTTACAACAATGGGCAGTGAGTCAACCGTCTGAGCAGAGAAATTTTCATCCTGAGCTGTGGTAGCTTGAA
AGCAAGGCCACTGTTGTCTCCAAATTCCCCTAGGACAGAAATGCCAAATCGTTGTTTCAAAGTTTTCATCCTGAGCTGTGGTAGCTTGAA
CCTGTTCCGCACATCATCGAAGCGATTTCCCAGGTAAGGGGTGTCCACAGTCACAAATATGCCTTGTAACCCATCTGCCCAGCCCTCTTCACTAG
CTGACTGCTGACCTCACGATCTTTGTAGATGTAGAGTTCCCATGGTCTGACAGTTCTGACAAACAGAAGTCGACAAGAAGTCGACATGAGCCTAGC
CCAGGAACTCAACATCAACATCATGGCATGCTCACTCTCTGTCCTAAAACAGAAGTCGACATCGACAAGAAGTCGACATGAGCCAGCCAGC
CCCAACGCATATTGGCAGAAGCCATGACAGAGACTCTTTCTGCTCGGTTAGAACTTGGAGGTCACCAAGTCTACTATGCCTCAGAAACTCTAGAATTTCCAAA
CTATAGTAGTCACAGAAGCCATGACAGAGACTCTTTCTGCTCGGTTAGAACTTGGAGGTCACCAAGTCTACTATGCCTCAGAAACTCTAGAATTTCCAAA
GCCAGCAAGGCAGTAT

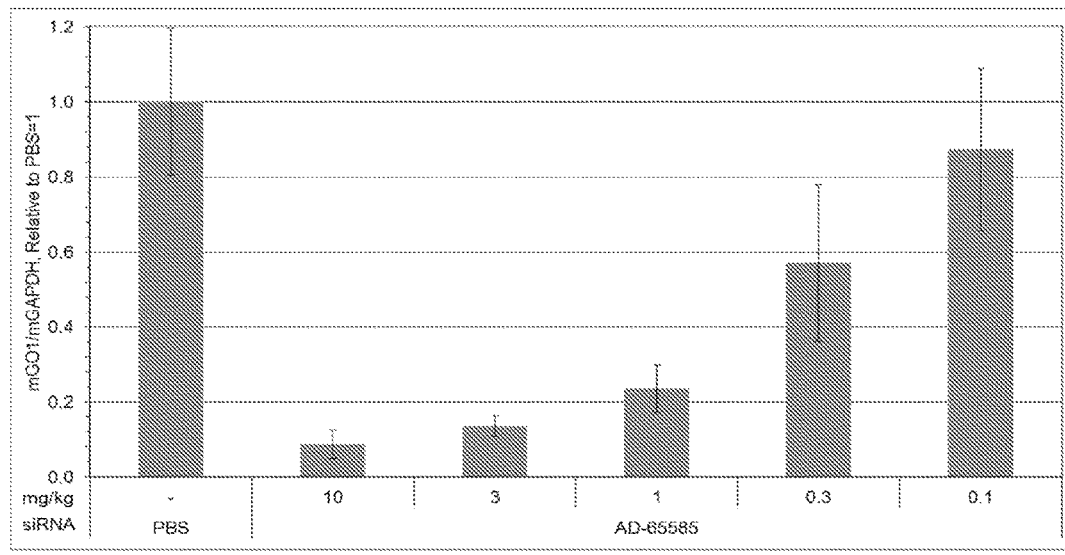
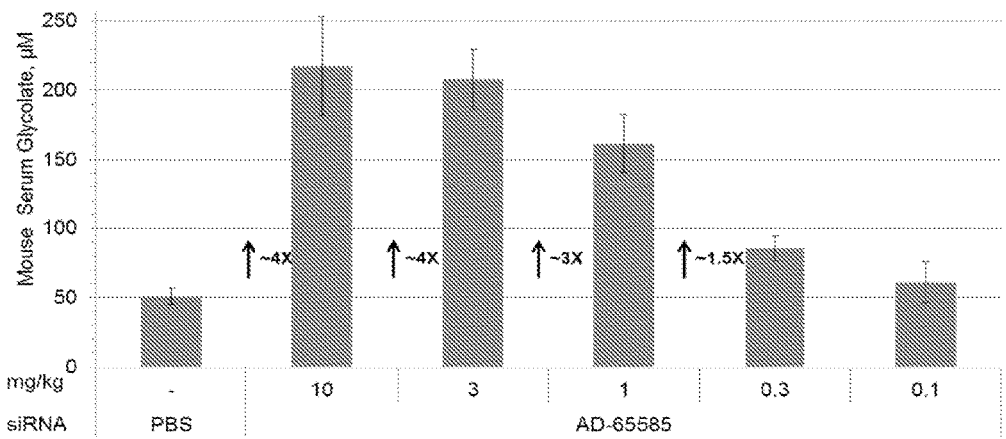
FIG. 18

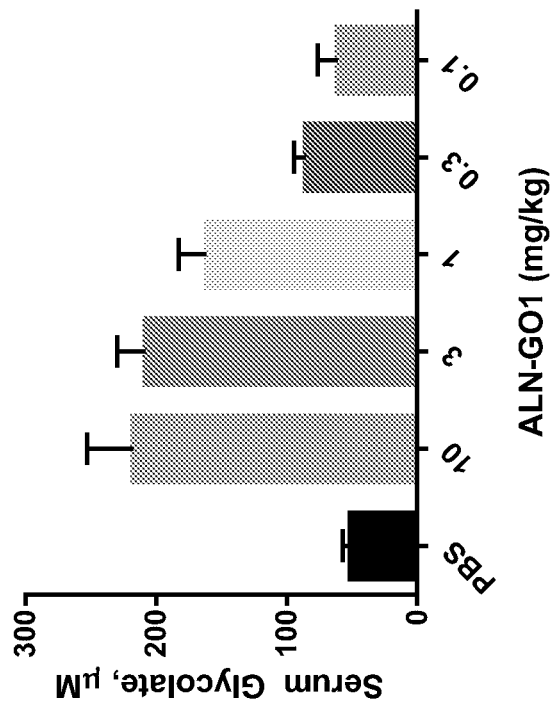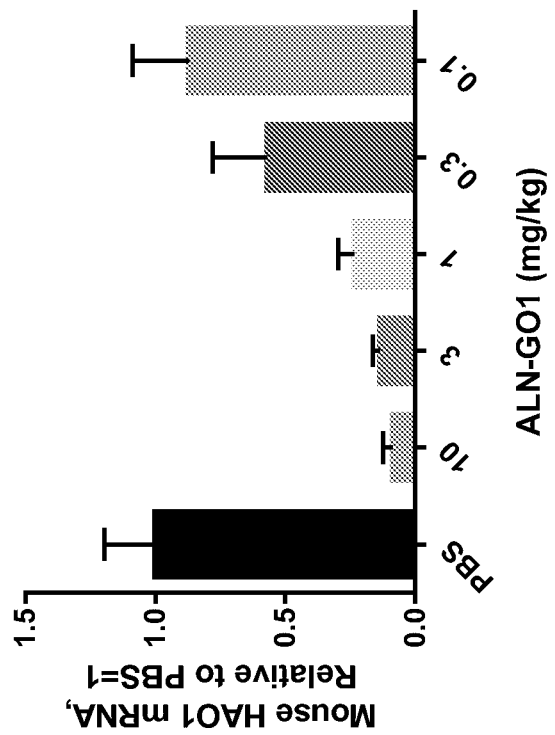
FIG. 21

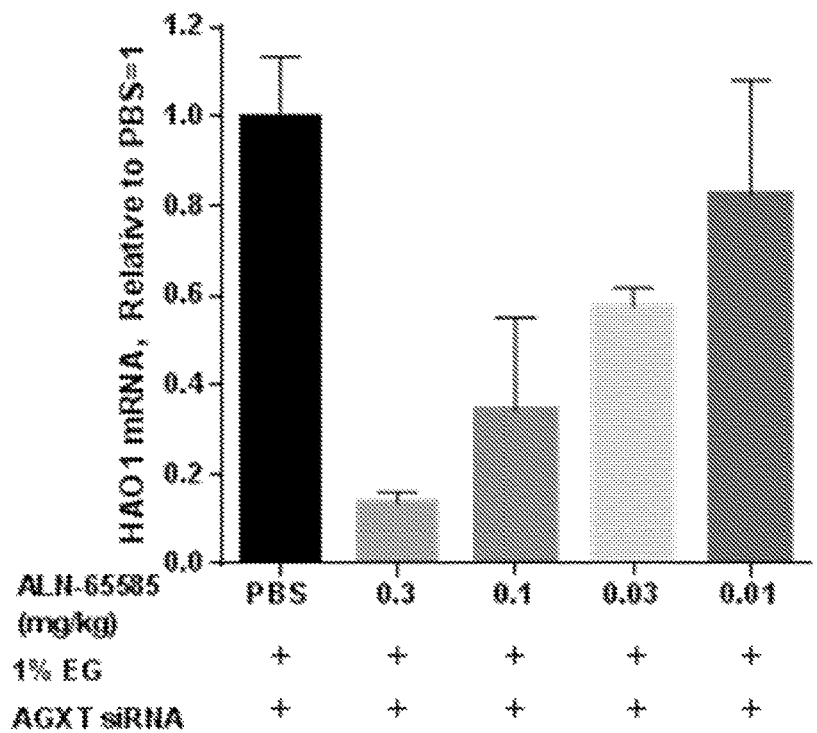
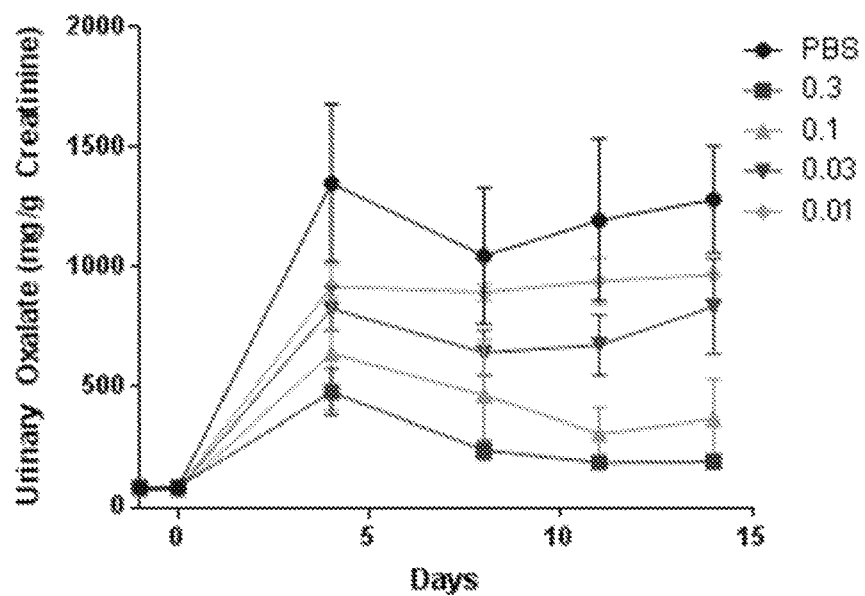
FIG. 25A

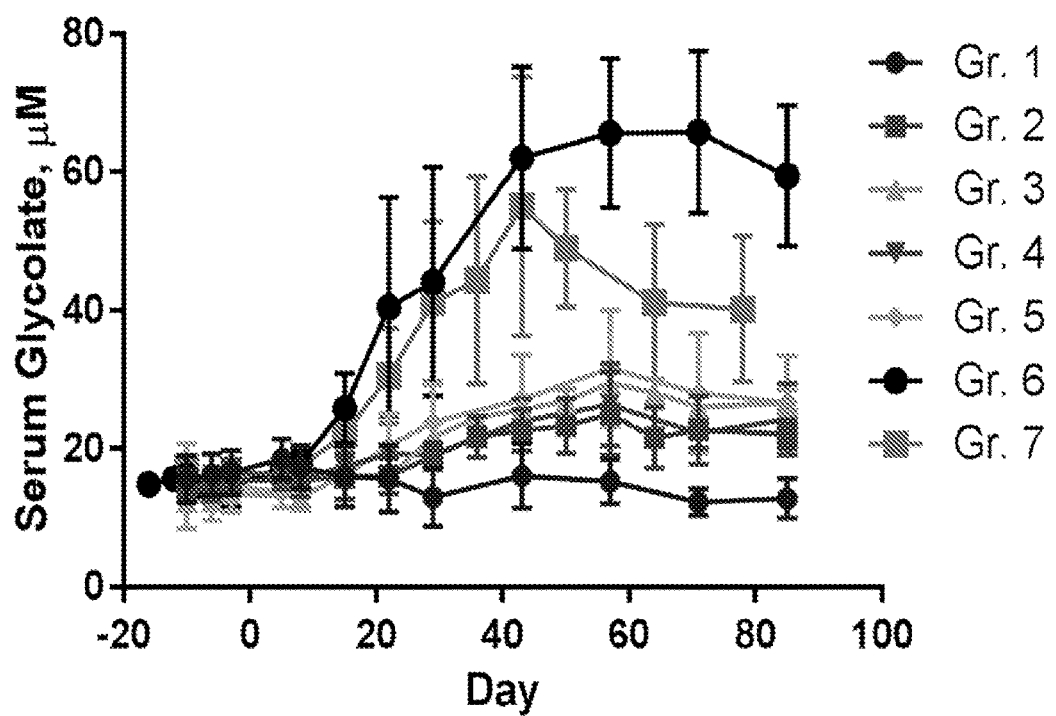
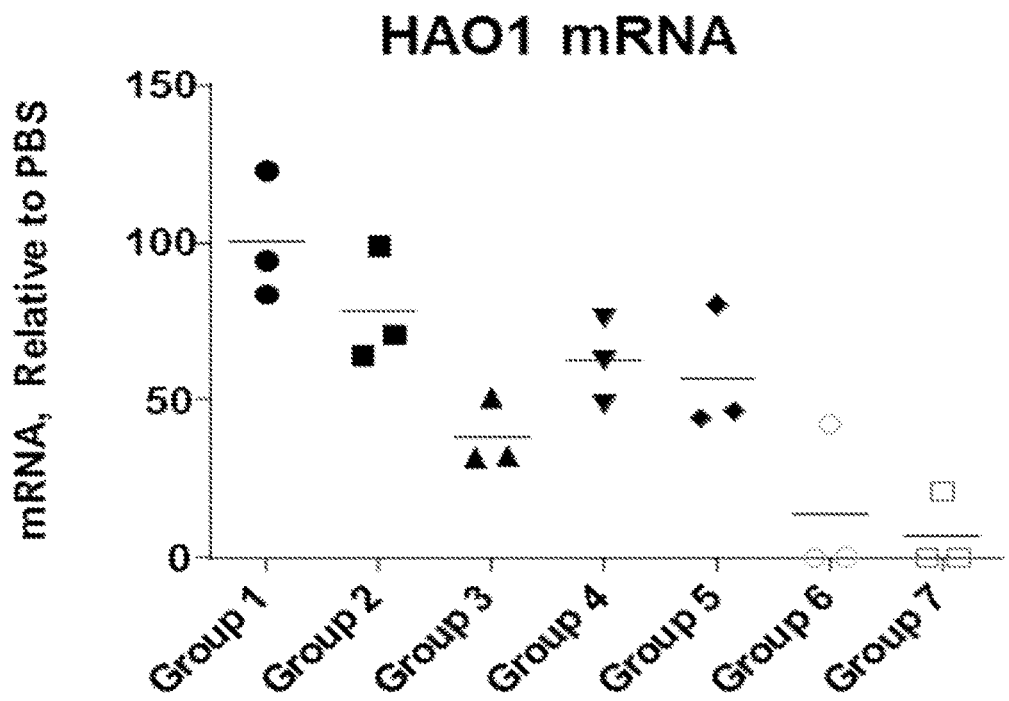
FIG. 27

COMPOSITIONS AND METHODS FOR INHIBITION OF HAO1 (HYDROXYACID OXIDASE 1 (GLYCOLATE OXIDASE)) GENE EXPRESSION

CROSS REFERENCE TO RELATED APPLICATIONS

This application is the National Stage of International Application No. PCT/US2015/054881, filed Oct. 9, 2015, which claims the benefit of and priority to U.S. Provisional Application No. 62/062,751, filed Oct. 10, 2014, and U.S. Provisional Application No. 62/147,976, filed Apr. 15, 2015, and U.S. Provisional Application No. 62/214,602, filed Sep. 4, 2015, each of which is hereby incorporated in its entirety by reference.

SEQUENCE LISTING

The instant application contains a Sequence Listing which has been submitted electronically in ASCII format and is hereby incorporated by reference in its entirety. Said ASCII copy, created on Oct. 8, 2015, is named 30864PCT_CRF-_sequencelisting.txt and is 735,705 bytes in size.

BACKGROUND OF THE INVENTION

Primary Hyperoxaluria Type 1 (PH1) is an autosomal recessive disorder of glyoxylate metabolism. Hepatic glyoxylate detoxification is impaired due to mutation of the AGXT gene, which encodes the liver peroxisomal alanine-glyoxylate aminotransferase (AGT) enzyme. AGT1 is the final enzyme in the metabolic breakdown of hydroxyproline. Loss of AGT function to convert the intermediate metabolite glyoxylate to glycine causes accumulation and reduction of glyoxylate to glycolate which is oxidized to oxalate by the enzyme glycolate oxidase (GO), also known as hydroxyacid oxidase (HAO1).

Regulation of glyoxylate, the key precursor of oxalate, occurs at multiple cellular sites including the mitochondria, peroxisome and the cytosol. Excess oxalate in PH1 patients is unable to be fully excreted by the kidneys leading to the formation and deposition of calcium oxalate crystals in the kidneys and urinary tract. Renal damage is caused by a combination of tubular toxicity from oxalate, nephrocalcinosis and renal obstruction by stones. Greater than 30% of patients advance to end stage renal disease (ESRD).

The HAO1 gene encodes the enzyme Hydroxyacid Oxidase 1, also known as Glycolate Oxidase ("GO"). The HAO1 protein is expressed primarily in the liver and is a 2-hydroxyacid oxidase most active on glycolate.

In a mouse model of PH1, where the AGT1 gene is deleted, urine oxalate levels are reduced when the HAO1 gene is deleted.

PH1, AGXT, and HAO1 are described in the following: Angel L. Pey, Armando Albert, and Eduardo Salido, "Protein Homeostasis Defects of Alanine-Glyoxylate Aminotransferase: New Therapeutic Strategies in Primary Hyperoxaluria Type 1," BioMed Research International, vol. 2013. Article ID 687658, 15 pages, 2013. doi:10.1155/2013/687658; Cochat and Rumsby (2013) NEJM 369:7; Salido et al (2006) PNAS 103:18249; Baker et al (2004) American Journal of Physiology—Heart and Circulatory Physiology Published 1 Oct. 2004 Vol. 287 no. 4, H1771-H1779DOI: 10.1152/ajpheart.00234.2004.

SUMMARY OF THE INVENTION

The present invention provides compositions comprising RNAi agents, e.g., double-stranded iRNA agents, targeting HAO1. The present invention also provides methods using the compositions of the invention for inhibiting HAO1 expression and for treating HAO1 associated disorders, e.g., PH1.

BRIEF DESCRIPTION OF THE DRAWINGS

FIG. 1 shows the nucleotide sequence of *Homo sapiens* HAO1 mRNA (SEQ ID NO:1).

FIG. 2 shows the nucleotide sequence of *Mus musculus* HAO1 mRNA (SEQ ID NO:2).

FIG. 7 shows the reverse complement of the nucleotide sequence of *Homo sapiens* HAO1 mRNA (SEQ ID NO:3).

FIG. 8 shows the reverse complement of the nucleotide sequence of *Mus musculus* HAO1 mRNA (SEQ ID NO:4).

FIG. 9 shows the nucleotide sequence of *Macaca fascicularis* HAO1 mRNA (SEQ ID NO:5).

FIG. 10 shows the nucleotide sequence of *Rattus norvegicus* HAO1 mRNA (SEQ ID NO:6).

FIG. 11 shows the reverse complement of the nucleotide sequence of *Macaca fascicularis* HAO1 mRNA (SEQ ID NO:7).

FIG. 12 shows the reverse complement of the nucleotide sequence of *Rattus norvegicus* HAO1 mRNA (SEQ ID NO:8).

FIG. 18 is two graphs showing the relationship of mRNA knockdown to serum glycolate levels in mice.

FIG. 21 is two graphs showing HAO1 mRNA and serum glycolate levels following single does treatment with ALN-GO1 in mice.

FIG. 25A is a graph showing HAO1 mRNA levels in a rat model of primary hyperoxaluria type I after a single dose of ALN-GO1.

FIG. 27 is two graphs showing HAO1 mRNA and serum glycolate levels after repeat dosing in non-human primates.

DETAILED DESCRIPTION OF THE INVENTION

Figure 3A:
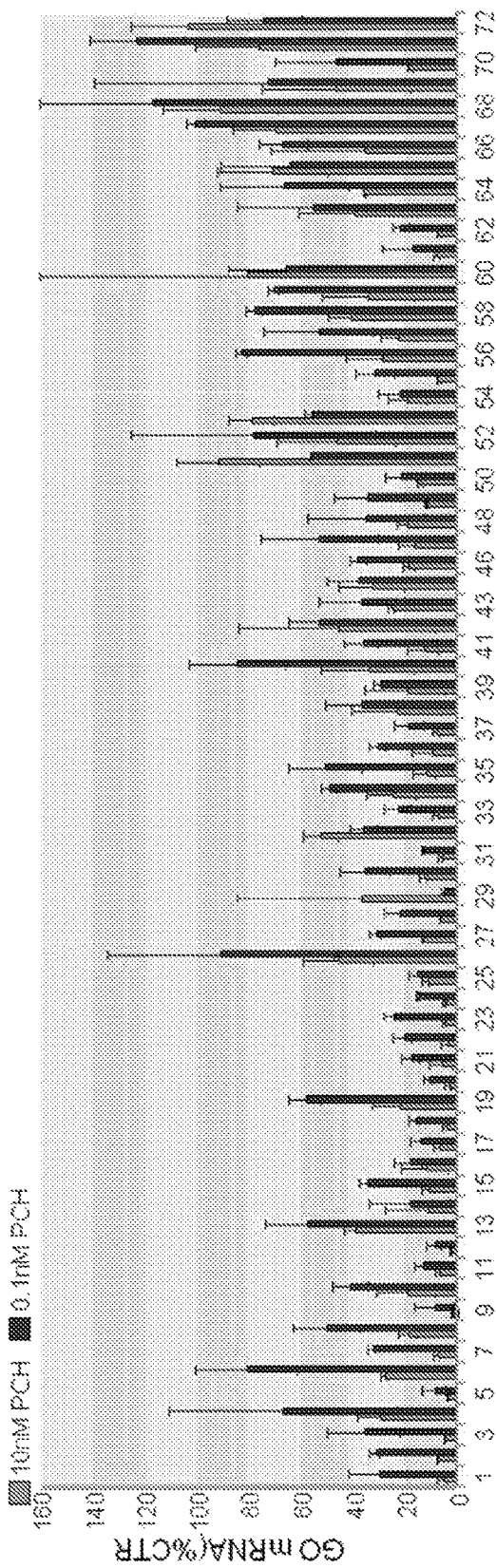
FIG. 3A is a graph with the results of in vitro screening of GO (HAO) GalNac-siRNA conjugates in primary cynomologous monkey hepatocytes.

The present invention provides compositions comprising RNAi agents, e.g., double-stranded RNAi agents, targeting HAO1. The present invention also provides methods using the compositions of the invention for inhibiting HAO1 expression and for treating HAO1 associated disorders.

I. Definitions

In order that the present invention may be more readily understood, certain terms are first defined. In addition, it should be noted that whenever a value or range of values of a parameter are recited, it is intended that values and ranges intermediate to the recited values are also intended to be part of this invention.

The articles "a" and "an" are used herein to refer to one or to more than one (i.e., to at least one) of the grammatical object of the article. By way of example, "an element" means one element or more than one element, e.g., a plurality of elements.

The term "including" is used herein to mean, and is used interchangeably with, the phrase "including but not limited to".

The term "or" is used herein to mean, and is used interchangeably with, the term "and/or," unless context clearly indicates otherwise.

As used herein, "HAO1" refers to the gene encoding the enzyme hydroxyacid oxidase 1. Other gene names include GO, GOX, GOX1, and HAOX1. The protein is also known as glycolate oxidase and (S)-2-hydroxy-acid oxidase. The GenBank accession number of the human HAO mRNA is NM_017545.2; cynomolgous monkey (*Macaca fascicularis*) HAO1 mRNA is XM_005568381.1; Mouse (*Mus musculus*) HAO1 mRNA is NM_010403.2; Rat (*Rattus norvegicus*) HAO1 mRNA is XM_006235096.1.

The term "HAO1," as used herein, also refers to naturally occurring DNA sequence variations of the HAO1 gene, such as a single nucleotide polymorphism (SNP) in the HAO1 gene. Exemplary SNPs may be found in the NCBI dbSNP Short Genetic Variations database available at www.ncbi.nlm.nih.gov/projects/SNP.

As used herein, "target sequence" refers to a contiguous portion of the nucleotide sequence of an mRNA molecule formed during the transcription of a HAO1 gene, including mRNA that is a product of RNA processing of a primary transcription product.

As used herein, the term "strand comprising a sequence" refers to an oligonucleotide comprising a chain of nucleotides that is described by the sequence referred to using the standard nucleotide nomenclature.

"G," "C," "A" and "U" each generally stand for a nucleotide that contains guanine, cytosine, adenine, and uracil as a base, respectively. "T" and "dT" are used interchangeably herein and refer to a deoxyribonucleotide wherein the nucleobase is thymine, e.g., deoxyribothymine, 2'-deoxythymidine or thymidine. However, it will be understood that the term "ribonucleotide" or "nucleotide" or "deoxyribonucleotide" can also refer to a modified nucleotide, as further detailed below, or a surrogate replacement moiety. The skilled person is well aware that guanine, cytosine, adenine, and uracil may be replaced by other moieties without substantially altering the base pairing properties of an oligonucleotide comprising a nucleotide bearing such replacement moiety. For example, without limitation, a nucleotide comprising inosine as its base may base pair with nucleotides containing adenine, cytosine, or uracil. Hence, nucleotides containing uracil, guanine, or adenine may be replaced in the nucleotide sequences of the invention by a nucleotide containing, for example, inosine. Sequences comprising such replacement moieties are embodiments of the invention.

The terms "iRNA", "RNAi agent," "iRNA agent,", "RNA interference agent" as used interchangeably herein, refer to an agent that contains RNA as that term is defined herein, and which mediates the targeted cleavage of an RNA transcript via an RNA-induced silencing complex (RISC) pathway. iRNA directs the sequence-specific degradation of mRNA through a process as RNA interference (RNAi). The iRNA modulates, e.g., inhibits, the expression of HAO1 in a cell, e.g., a cell within a subject, such as a mammalian subject.

In one embodiment, an RNAi agent of the invention includes a single stranded RNA that interacts with a target RNA sequence, e.g., a HAO1 target mRNA sequence, to direct the cleavage of the target RNA. Without wishing to be bound by theory, it is believed that long double stranded RNA introduced into cells is broken down into siRNA by a Type III endonuclease known as Dicer (Sharp et al. (2001) *Genes Dev.* 15:485). Dicer, a ribonuclease-III-like enzyme, processes the dsRNA into 19-23 base pair short interfering RNAs with characteristic two base 3' overhangs (Bernstein, et al., (2001) *Nature* 409:363). The siRNAs are then incorporated into an RNA-induced silencing complex (RISC) where one or more helicases unwind the siRNA duplex, enabling the complementary antisense strand to guide target recognition (Nykanen, et al., (2001) *Cell* 107:309). Upon binding to the appropriate target mRNA, one or more endonucleases within the RISC cleave the target to induce silencing (Elbashir, et al., (2001) *Genes Dev.* 15:188). Thus, in one aspect the invention relates to a single stranded RNA (siRNA) generated within a cell and which promotes the formation of a RISC complex to effect silencing of the target gene, i.e., a HAO1 gene. Accordingly, the term "siRNA" is also used herein to refer to an RNAi as described above.

In another embodiment, the RNAi agent may be a single-stranded siRNA that is introduced into a cell or organism to inhibit a target mRNA. Single-stranded RNAi agents bind to the RISC endonuclease Argonaute 2, which then cleaves the target mRNA. The single-stranded siRNAs are generally 15-30 nucleotides and are chemically modified. The design and testing of single-stranded siRNAs are described in U.S. Pat. No. 8,101,348 and in Lima et al., (2012) *Cell* 150: 883-894, the entire contents of each of which are hereby incorporated herein by reference. Any of the antisense nucleotide sequences described herein may be used as a single-stranded siRNA as described herein or as chemically modified by the methods described in Lima et al., (2012) *Cell* 150:883-894.

In yet another embodiment, the present invention provides single-stranded antisense oligonucleotide molecules targeting HAO1. A "single-stranded antisense oligonucleotide molecule" is complementary to a sequence within the target mRNA (i.e., HAO1). Single-stranded antisense oligonucleotide molecules can inhibit translation in a stoichiometric manner by base pairing to the mRNA and physically obstructing the translation machinery, see Dias, N. et al., (2002) *Mol Cancer Ther* 1:347-355. Alternatively, the single-stranded antisense oligonucleotide molecules inhibit a target mRNA by hydrizing to the target and cleaving the target through an RNaseH cleavage event. The single-stranded antisense oligonucleotide molecule may be about 10 to about 30 nucleotides in length and have a sequence that is complementary to a target sequence. For example, the single-stranded antisense oligonucleotide molecule may comprise a sequence that is at least about 10, 11, 12, 13, 14, 15, 16, 17, 18, 19, 20, or more contiguous nucleotides from any one of the antisense nucleotide sequences described herein, e.g., the sequences provided in any one of Tables 1 or 2, or bind any of the target sites described herein. The single-stranded antisense oligonucleotide molecules may comprise modified RNA, DNA, or a combination thereof.

In another embodiment, an "iRNA" for use in the compositions, uses, and methods of the invention is a double-stranded RNA and is referred to herein as a "double stranded RNAi agent," "double-stranded RNA (dsRNA) molecule," "dsRNA agent," or "dsRNA". The term "dsRNA", refers to a complex of ribonucleic acid molecules, having a duplex structure comprising two anti-parallel and substantially complementary nucleic acid strands, referred to as having "sense" and "antisense" orientations with respect to a target RNA, i.e., a HAO1 gene. In some embodiments of the invention, a double-stranded RNA (dsRNA) triggers the degradation of a target RNA, e.g., an mRNA, through a post-transcriptional gene-silencing mechanism referred to herein as RNA interference or RNAi.

In general, the majority of nucleotides of each strand of a dsRNA molecule are ribonucleotides, but as described in detail herein, each or both strands can also include one or more non-ribonucleotides, e.g., a deoxyribonucleotide and/or a modified nucleotide. In addition, as used in this specification, an "RNAi agent" may include ribonucleotides with chemical modifications; an RNAi agent may include substantial modifications at multiple nucleotides. Such modifications may include all types of modifications disclosed herein or known in the art. Any such modifications, as used in a siRNA type molecule, are encompassed by "RNAi agent" for the purposes of this specification and claims.

The two strands forming the duplex structure may be different portions of one larger RNA molecule, or they may be separate RNA molecules. Where the two strands are part of one larger molecule, and therefore are connected by an uninterrupted chain of nucleotides between the 3'-end of one strand and the 5'-end of the respective other strand forming the duplex structure, the connecting RNA chain is referred to as a "hairpin loop." Where the two strands are connected covalently by means other than an uninterrupted chain of nucleotides between the 3'-end of one strand and the 5'-end of the respective other strand forming the duplex structure, the connecting structure is referred to as a "linker." The RNA strands may have the same or a different number of nucleotides. The maximum number of base pairs is the number of nucleotides in the shortest strand of the dsRNA minus any overhangs that are present in the duplex. In addition to the duplex structure, an RNAi agent may comprise one or more nucleotide overhangs.

In one embodiment, an RNAi agent of the invention is a dsRNA of 24-30 nucleotides that interacts with a target RNA sequence, e.g., a HAO1 target mRNA sequence, to direct the cleavage of the target RNA. Without wishing to be bound by theory, long double stranded RNA introduced into cells is broken down into siRNA by a Type III endonuclease known as Dicer (Sharp et al. (2001) Genes Dev. 15:485). Dicer, a ribonuclease-III-like enzyme, processes the dsRNA into 19-23 base pair short interfering RNAs with characteristic two base 3' overhangs (Bernstein, et al., (2001) Nature 409:363). The siRNAs are then incorporated into an RNA-induced silencing complex (RISC) where one or more helicases unwind the siRNA duplex, enabling the complementary antisense strand to guide target recognition (Nykanen, et al., (2001) Cell 107:309). Upon binding to the appropriate target mRNA, one or more endonucleases within the RISC cleave the target to induce silencing (Elbashir, et al., (2001) Genes Dev. 15:188).

As used herein, a "nucleotide overhang" refers to the unpaired nucleotide or nucleotides that protrude from the duplex structure of an RNAi agent when a 3'-end of one strand of the RNAi agent extends beyond the 5'-end of the other strand, or vice versa. "Blunt" or "blunt end" means that there are no unpaired nucleotides at that end of the double stranded RNAi agent, i.e., no nucleotide overhang. A "blunt ended" RNAi agent is a dsRNA that is double-stranded over its entire length, i.e., no nucleotide overhang at either end of the molecule. The RNAi agents of the invention include RNAi agents with nucleotide overhangs at one end (i.e., agents with one overhang and one blunt end) or with nucleotide overhangs at both ends.

The term "antisense strand" refers to the strand of a double stranded RNAi agent which includes a region that is substantially complementary to a target sequence (e.g., a human HAO1 mRNA). As used herein, the term "region complementary to part of an mRNA encoding HAO1" refers to a region on the antisense strand that is substantially complementary to part of a HAO1 mRNA sequence. Where the region of complementarity is not fully complementary to the target sequence, the mismatches are most tolerated in the terminal regions and, if present, are generally in a terminal region or regions, e.g., within 6, 5, 4, 3, or 2 nucleotides of the 5' and/or 3' terminus.

The term "sense strand," as used herein, refers to the strand of a dsRNA that includes a region that is substantially complementary to a region of the antisense strand.

As used herein, the term "cleavage region" refers to a region that is located immediately adjacent to the cleavage site. The cleavage site is the site on the target at which cleavage occurs. In some embodiments, the cleavage region comprises three bases on either end of, and immediately adjacent to, the cleavage site. In some embodiments, the cleavage region comprises two bases on either end of, and immediately adjacent to, the cleavage site. In some embodiments, the cleavage site specifically occurs at the site bound by nucleotides 10 and 11 of the antisense strand, and the cleavage region comprises nucleotides 11, 12 and 13.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can, for example, be stringent conditions, where stringent conditions may include: 400 mM NaCl, 40 mM PIPES pH 6.4, 1 mM EDTA, 50° C. or 70° C. for 12-16 hours followed by washing. Other conditions, such as physiologically relevant conditions as may be encountered inside an organism, can apply. For example, a complementary sequence is sufficient to allow the relevant function of the nucleic acid to proceed, e.g., RNAi. The skilled person will be able to determine the set of conditions most appropriate for a test of complementarity of two sequences in accordance with the ultimate application of the hybridized nucleotides.

Sequences can be "fully complementary" with respect to each when there is base-pairing of the nucleotides of the first nucleotide sequence with the nucleotides of the second nucleotide sequence over the entire length of the first and second nucleotide sequences. However, where a first sequence is referred to as "substantially complementary" with respect to a second sequence herein, the two sequences can be fully complementary, or they may form one or more, but generally not more than 4, 3 or 2 mismatched base pairs upon hybridization, while retaining the ability to hybridize under the conditions most relevant to their ultimate application. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, may yet be referred to as "fully complementary" for the purposes described herein.

"Complementary" sequences, as used herein, may also include, or be formed entirely from, non-Watson-Crick base pairs and/or base pairs formed from non-natural and modified nucleotides, in as far as the above requirements with respect to their ability to hybridize are fulfilled. Such non-Watson-Crick base pairs includes, but not limited to, G:U Wobble or Hoogstein base pairing.

The terms "complementary," "fully complementary" and "substantially complementary" herein may be used with respect to the base matching between the sense strand and the antisense strand of a dsRNA, or between the antisense strand of a dsRNA and a target sequence, as will be understood from the context of their use.

As used herein, a polynucleotide that is "substantially complementary to at least part of" a messenger RNA (mRNA) refers to a polynucleotide that is substantially complementary to a contiguous portion of the mRNA of interest (e.g., an mRNA encoding HAO1) including a 5' UTR, an open reading frame (ORF), or a 3' UTR. For example, a polynucleotide is complementary to at least a part of a HAO1 mRNA if the sequence is substantially complementary to a non-interrupted portion of an mRNA encoding HAO1.

The term "inhibiting," as used herein, is used interchangeably with "reducing." "silencing," "downregulating," "suppressing" and other similar terms, and includes any level of inhibition.

The phrase "inhibiting expression of a HAO1," as used herein, includes inhibition of expression of any HAO1 gene (such as, e.g., a mouse HAO1 gene, a rat HAO1 gene, a monkey HAO1 gene, or a human HAO1 gene) as well as variants, (e.g., naturally occurring variants), or mutants of a HAO1 gene. Thus, the HAO1 gene may be a wild-type HAO1 gene, a mutant HAO1 gene, or a transgenic HAO1 gene in the context of a genetically manipulated cell, group of cells, or organism.

"Inhibiting expression of a HAO1 gene" includes any level of inhibition of a HAO1 gene, e.g., at least partial suppression of the expression of a HAO1 gene, such as an inhibition of at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99%.

The expression of a HAO1 gene may be assessed based on the level of any variable associated with HAO1 gene expression, e.g., HAO1 mRNA level or HAO1 protein level, in, e.g., tissues and/or urinary oxalate levels. Inhibition may be assessed by a decrease in an absolute or relative level of one or more of these variables compared with a control level. The control level may be any type of control level that is utilized in the art, e.g., a pre-dose baseline level, or a level determined from a similar subject, cell, or sample that is untreated or treated with a control (such as, e.g., buffer only control or inactive agent control).

The phrase "contacting a cell with a double stranded RNAi agent." as used herein, includes contacting a cell by any possible means. Contacting a cell with a double stranded RNAi agent includes contacting a cell in vitro with the RNAi agent or contacting a cell in vivo with the RNAi agent. The contacting may be done directly or indirectly. Thus, for example, the RNAi agent may be put into physical contact with the cell by the individual performing the method, or alternatively, the RNAi agent may be put into a situation that will permit or cause it to subsequently come into contact with the cell.

Contacting a cell in vitro may be done, for example, by incubating the cell with the RNAi agent. Contacting a cell in vivo may be done, for example, by injecting the RNAi agent into or near the tissue where the cell is located, or by injecting the RNAi agent into another area, the bloodstream or the subcutaneous space, such that the agent will subsequently reach the tissue where the cell to be contacted is located. For example, the RNAi agent may contain and/or be coupled to a ligand, e.g., a GalNAc3 ligand, that directs the RNAi agent to a site of interest, e.g., the liver. Combinations of in vitro and in vivo methods of contacting are also possible. In connection with the methods of the invention, a cell might also be contacted in vitro with an RNAi agent and subsequently transplanted into a subject.

As used herein, a "subject" includes a human or non-human animal, preferably a vertebrate, and more preferably a mammal. A subject may include a transgenic organism. Most preferably, the subject is a human, such as a human suffering from or predisposed to developing a HAO1 associated disorder.

A "patient" or "subject," as used herein, is intended to include either a human or non-human animal, preferably a mammal, e.g., human or a monkey. Most preferably, the subject or patient is a human.

A "HAO1 associated disorder", as used herein, is intended to include any disorder that can be treated or prevented, or the symptoms of which can be alleviated, by inhibiting the expression of HAO1. Examples include but are not limited to Primary Hyperoxaluria 1 (PH1).

"Therapeutically effective amount," as used herein, is intended to include the amount of an RNAi agent that, when administered to a patient for treating a HAO1 associated disease, is sufficient to effect treatment of the disease (e.g., by diminishing, ameliorating or maintaining the existing disease or one or more symptoms of disease). The "therapeutically effective amount" may vary depending on the RNAi agent, how the agent is administered, the disease and its severity and the history, age, weight, family history, genetic makeup, stage of pathological processes mediated by HAO1 expression, the types of preceding or concomitant treatments, if any, and other individual characteristics of the patient to be treated.

"Prophylactically effective amount," as used herein, is intended to include the amount of an RNAi agent that, when administered to a subject who does not yet experience or display symptoms of a HAO1-associated disease, but who may be predisposed to the disease, is sufficient to prevent or ameliorate the disease or one or more symptoms of the disease. Ameliorating the disease includes slowing the course of the disease or reducing the severity of later-developing disease. The "prophylactically effective amount" may vary depending on the RNAi agent, how the agent is administered, the degree of risk of disease, and the history, age, weight, family history, genetic makeup, the types of preceding or concomitant treatments, if any, and other individual characteristics of the patient to be treated.

A "therapeutically-effective amount" or "prophylactically effective amount" also includes an amount of an RNAi agent that produces some desired local or systemic effect at a reasonable benefit/risk ratio applicable to any treatment. RNAi gents employed in the methods of the present invention may be administered in a sufficient amount to produce a reasonable benefit/risk ratio applicable to such treatment.

The term "sample," as used herein, includes a collection of similar fluids, cells, or tissues isolated from a subject, as well as fluids, cells, or tissues present within a subject. Examples of biological fluids include blood, serum and serosal fluids, plasma, cerebrospinal fluid, ocular fluids, lymph, urine, saliva, and the like. Tissue samples may include samples from tissues, organs or localized regions. For example, samples may be derived from particular organs, parts of organs, or fluids or cells within those organs. In certain embodiments, samples may be derived from the liver (e.g., whole liver or certain segments of liver or certain types of cells in the liver, such as, e.g., hepatocytes). In some embodiments, a "sample derived from a subject" refers to blood or plasma drawn from the subject. In further embodiments, a "sample derived from a subject" refers to liver tissue (or subcomponents thereof) derived from the subject.

II. dsRNA IRNA Agents of the Invention

Described herein are double-stranded RNAi agents which inhibit the expression of a HAO1 gene in a cell, such as a cell within a subject, e.g., a mammal, such as a human having a HAO1 associated disorder, and uses of such double-stranded RNAi agents.

Accordingly, the invention provides double-stranded RNAi agents with chemical modifications capable of inhibiting the expression of a target gene (i.e., a HAO1 gene) in vivo.

As described in more detail below, in certain aspects of the invention, substantially all of the nucleotides of an iRNA of the invention are modified. In other embodiments of the invention, all of the nucleotides of an iRNA of the invention are modified. iRNAs of the invention in which "substantially all of the nucleotides are modified" are largely but not wholly modified and can include not more than 5, 4, 3, 2, or 1 unmodified nucleotides.

The RNAi agent comprises a sense strand and an antisense strand. Each strand of the RNAi agent may range from 12-30 nucleotides in length. For example, each strand may be between 14-30 nucleotides in length, 17-30 nucleotides in length, 19-30 nucleotides in length, 25-30 nucleotides in length, 27-30 nucleotides in length, 17-23 nucleotides in length, 17-21 nucleotides in length, 17-19 nucleotides in length, 19-25 nucleotides in length, 19-23 nucleotides in length, 19-21 nucleotides in length, 21-25 nucleotides in length, or 21-23 nucleotides in length.

Each strand can be 12, 13, 14, 15, 16, 17, 18, 19, 20, 21, 22, 23, 24, 25, 26, 27, 28, 29, or 30 nucleotides in length. Each strand of the RNAi agent can be the same length or can be different lengths.

The sense strand and antisense strand typically form a duplex double stranded RNA ("dsRNA"), also referred to herein as an "RNAi agent." The duplex region of an RNAi agent may be 12-30 nucleotide pairs in length. For example, the duplex region can be between 14-nucleotide pairs in length, 17-30 nucleotide pairs in length, 27-30 nucleotide pairs in length, 17-23 nucleotide pairs in length, 17-21 nucleotide pairs in length, 17-19 nucleotide pairs in length, 19-25 nucleotide pairs in length, 19-23 nucleotide pairs in length, 19-21 nucleotide pairs in length, 21-25 nucleotide pairs in length, or 21-23 nucleotide pairs in length. In another example, the duplex region is selected from 15, 16, 17, 18, 19, 20, 21, 22, 23, 24, 25, 26, and 27 nucleotide pairs in length.

In one embodiment, the RNAi agent may contain one or more overhang regions and/or capping groups at the 3'-end, 5'-end, or both ends of one or both strands. The overhang can be 1-6 nucleotides in length, for instance 2-6 nucleotides in length, 1-5 nucleotides in length, 2-5 nucleotides in length, 1-4 nucleotides in length, 2-4 nucleotides in length, 1-3 nucleotides in length, 2-3 nucleotides in length, or 1-2 nucleotides in length. The overhangs can be the result of one strand being longer than the other, or the result of two strands of the same length being staggered. The overhang can form a mismatch with the target mRNA or it can be complementary to the gene sequences being targeted or can be another sequence. The first and second strands can also be joined, e.g., by additional bases to form a hairpin, or by other non-base linkers.

In one embodiment, the nucleotides in the overhang region of the RNAi agent can each independently be a modified or unmodified nucleotide including, but not limited to 2'-sugar modified, such as, 2-F, 2'-O-methyl, thymidine (T), 2'-O-methoxyethyl-5-methyluridine (Teo), 2'-O- methoxyethyladenosine (Aeo), 2'-O-methoxyethyl-5-methylcytidine (m5Ceo), and any combinations thereof. For example, TT can be an overhang sequence for either end on either strand. The overhang can form a mismatch with the target mRNA or it can be complementary to the gene sequences being targeted or can be another sequence.

The 5'- or 3'-overhangs at the sense strand, antisense strand or both strands of the RNAi agent may be phosphorylated. In some embodiments, the overhang region(s) contains two nucleotides having a phosphorothioate between the two nucleotides, where the two nucleotides can be the same or different. In one embodiment, the overhang is present at the 3'-end of the sense strand, antisense strand, or both strands. In one embodiment, this 3'-overhang is present in the antisense strand. In one embodiment, this 3'-overhang is present in the sense strand.

The RNAi agent may contain only a single overhang, which can strengthen the interference activity of the RNAi, without affecting its overall stability. For example, the single-stranded overhang may be located at the 3'-terminal end of the sense strand or, alternatively, at the 3'-terminal end of the antisense strand. The RNAi may also have a blunt end, located at the 5'-end of the antisense strand (or the 3'-end of the sense strand) or vice versa. Generally, the antisense strand of the RNAi has a nucleotide overhang at the 3'-end, and the 5'-end is blunt. While not wishing to be bound by theory, the asymmetric blunt end at the 5'-end of the antisense strand and 3'-end overhang of the antisense strand favor the guide strand loading into RISC process.

Synthesis and Modifications

Any of the nucleic acids, e.g., RNAi, featured in the invention can be synthesized and/or modified by methods well established in the art, such as those described in "Current protocols in nucleic acid chemistry," Beaucage. S. L. et al. (Edrs.), John Wiley & Sons. Inc., New York, N.Y., USA, which is hereby incorporated herein by reference. Modifications include, for example, end modifications, e.g., 5'-end modifications (phosphorylation, conjugation, inverted linkages) or 3'-end modifications (conjugation. DNA nucleotides, inverted linkages, etc.); base modifications. e.g., replacement with stabilizing bases, destabilizing bases, or bases that base pair with an expanded repertoire of partners, removal of bases (abasic nucleotides), or conjugated bases; sugar modifications (e.g., at the 2'-position or 4'-position) or replacement of the sugar; and/or backbone modifications, including modification or replacement of the phosphodiester linkages. Specific examples of iRNA compounds useful in the embodiments described herein include, but are not limited to RNAs containing modified backbones or no natural internucleoside linkages. RNAs having modified backbones include, among others, those that do not have a phosphorus atom in the backbone. For the purposes of this specification, and as sometimes referenced in the art, modified RNAs that do not have a phosphorus atom in their internucleoside backbone can also be considered to be oligonucleosides. In some embodiments, a modified iRNA will have a phosphorus atom in its internucleoside backbone.

Modified RNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5'-linked analogs of these, and those having inverted polarity wherein the adjacent pairs of nucleoside units are linked 3'-5' to 5'-3' or 2'-5' to 5'-2'. Various salts, mixed salts and free acid forms are also included.

Representative U.S. patents that teach the preparation of the above phosphorus-containing linkages include, but are not limited to, U.S. Pat. Nos. 3,687,808; 4,469,863; 4,476,301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,316; 5,550,111; 5,563,253; 5,571,799; 5,587,361; 5,625,050; 6,028,188; 6,124,445; 6,160,109; 6,169,170; 6,172,209; 6, 239,265; 6,277,603; 6,326,199; 6,346,614; 6,444,423; 6,531,590; 6,534,639; 6,608,035; 6,683,167; 6,858,715; 6,867,294; 6,878,805; 7,015,315; 7,041,816; 7,273,933; 7,321,029; and U.S. Pat. RE39464, the entire contents of each of which are hereby incorporated herein by reference.

Modified RNA backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

Representative U.S. patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and, 5,677,439, the entire contents of each of which are hereby incorporated herein by reference.

In other embodiments, suitable RNA mimetics are contemplated for use in iRNAs, in which both the sugar and the internucleoside linkage. i.e., the backbone, of the nucleotide units are replaced with novel groups. The base units are maintained for hybridization with an appropriate nucleic acid target compound. One such oligomeric compound, an RNA mimetic that has been shown to have excellent hybridization properties, is referred to as a peptide nucleic acid (PNA). In PNA compounds, the sugar backbone of an RNA is replaced with an amide containing backbone, in particular an aminoethylglycine backbone. The nucleobases are retained and are bound directly or indirectly to aza nitrogen atoms of the amide portion of the backbone. Representative U.S. patents that teach the preparation of PNA compounds include, but are not limited to, U.S. Pat. Nos. 5,539,082; 5,714,331; and 5,719,262, the entire contents of each of which are hereby incorporated herein by reference. Additional PNA compounds suitable for use in the iRNAs of the invention are described in, for example, in Nielsen et al., *Science,* 1991, 254, 1497-1500.

Some embodiments featured in the invention include RNAs with phosphorothioate backbones and oligonucleosides with heteroatom backbones, and in particular —$CH_2$—NH—$CH_2$—, —$CH_2$—$N(CH_3)$—O—$CH_2$—[known as a methylene (methylimino) or MMI backbone], —$CH_2$—O—$N(CH_3)$—$CH_2$—, —$CH_2$—$N(CH_3)$—$N(CH_3)$—$CH_2$— and —N(CH$_3$)—CH$_2$—CH$_2$— [wherein the native phosphodiester backbone is represented as —O—P—O—CH$_2$—] of the above-referenced U.S. Pat. No. 5,489,677, and the amide backbones of the above-referenced U.S. Pat. No. 5,602,240. In some embodiments, the RNAs featured herein have morpholino backbone structures of the above-referenced U.S. Pat. No. 5,034,506.

Modified RNAs can also contain one or more substituted sugar moieties. The iRNAs, e.g., dsRNAs, featured herein can include one of the following at the 2'-position: OH; F: O-, S-, or N-alkyl; O-, S-, or N-alkenyl; O-, S- or N-alkynyl; or O-alkyl-O-alkyl, wherein the alkyl, alkenyl and alkynyl can be substituted or unsubstituted C$_1$ to C$_{10}$ alkyl or C$_2$ to C$_{10}$ alkenyl and alkynyl. Exemplary suitable modifications include O[(CH$_2$)$_n$O]$_m$CH$_3$, O(CH$_2$)$_n$OCH$_3$, O(CH$_2$)$_n$NH$_2$, O(CH$_2$)$_n$CH$_3$, O(CH$_2$)$_n$ONH$_2$, and O(CH$_2$)$_n$ON[(CH$_2$)$_n$CH$_3$)]$_2$, where n and m are from 1 to about 10. In other embodiments, dsRNAs include one of the following at the 2' position: C$_1$ to C$_{10}$ lower alkyl, substituted lower alkyl, alkaryl, aralkyl, O-alkaryl or O-aralkyl, SH, SCH$_3$, OCN, Cl, Br, CN, CF$_3$, OCF$_3$, SOCH$_3$, SO$_2$CH$_3$, ONO$_2$, NO$_2$, N$_3$, NH$_2$, heterocycloalkyl, heterocycloalkaryl, aminoalkylamino, polyalkylamino, substituted silyl, an RNA cleaving group, a reporter group, an intercalator, a group for improving the pharmacokinetic properties of an iRNA, or a group for improving the pharmacodynamic properties of an iRNA, and other substituents having similar properties. In some embodiments, the modification includes a 2'-methoxyethoxy (2'-O—CH$_2$CH$_2$OCH$_3$, also known as 2'-O-(2-methoxyethyl) or 2'-MOE) (Martin et al., *Helv. Chim. Acta*, 1995, 78:486-504) i.e., an alkoxy-alkoxy group. Another exemplary modification is 2'-dimethylaminooxyethoxy, i.e., a O(CH$_2$)$_2$ON(CH$_3$)$_2$ group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—CH$_2$—O—CH$_2$—N(CH$_2$)$_2$.

Other modifications include 2'-methoxy (2'-OCH$_3$), 2'-aminopropoxy (2'-OCH$_2$CH$_2$CH$_2$NH$_2$) and 2'-fluoro (2'-F). Similar modifications can also be made at other positions on the RNA of an iRNA, particularly the 3' position of the sugar on the 3' terminal nucleotide or in 2'-5' linked dsRNAs and the 5' position of 5' terminal nucleotide. iRNAs can also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application. The entire contents of each of the foregoing are hereby incorporated herein by reference.

An iRNA can also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as deoxy-thymine (dT), 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. Further nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in The Concise Encyclopedia Of Polymer Science And Engineering, pages 858-859. Kroschwitz, J. L, ed. John Wiley & Sons, 1990, these disclosed by Englisch et al., Angewandte Chemie, International Edition, 1991, 30, 613, and those disclosed by Sanghvi, Y S., Chapter 15, dsRNA Research and Applications, pages 289-302, Crooke, S. T. and Lebleu, B., Ed., CRC Press, 1993. Certain of these nucleobases are particularly useful for increasing the binding affinity of the oligomeric compounds featured in the invention. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., dsRNA Research and Applications, CRC Press, Boca Raton, 1993, pp. 276-278) and are exemplary base substitutions, even more particularly when combined with 2'-O-methoxyethyl sugar modifications.

Representative U.S. patents that teach the preparation of certain of the above noted modified nucleobases as well as other modified nucleobases include, but are not limited to, the above noted U.S. Pat. Nos. 3,687,808, 4,845,205; 5,130, 30; 5,134,066; 5,175,273; 5,367,066; 5,432,272; 5,457,187; 5,459,255; 5,484,908; 5,502,177; 5,525,711; 5,552,540; 5,587,469; 5,594,121, 5,596,091; 5,614,617; 5,681,941; 5,750,692; 6,015,886; 6,147,200; 6,166,197; 6,222,025; 6,235,887; 6,380,368; 6,528,640; 6,639,062; 6,617,438; 7,045,610; 7,427,672; and 7,495,088, the entire contents of each of which are hereby incorporated herein by reference.

The RNA of an iRNA can also be modified to include one or more locked nucleic acids (LNA). A locked nucleic acid is a nucleotide having a modified ribose moiety in which the ribose moiety comprises an extra bridge connecting the 2' and 4' carbons. This structure effectively "locks" the ribose in the 3'-endo structural conformation. The addition of locked nucleic acids to siRNAs has been shown to increase siRNA stability in serum, and to reduce off-target effects (Elmen. J. et al., (2005) *Nucleic Acids Research* 33(1); 439-447; Mook, O R. et al., (2007) *Mol Canc Ther* 6(3): 833-843; Grunweller. A. et al., (2003) *Nucleic Acids Research* 31(12):3185-3193).

Representative U.S. patents that teach the preparation of locked nucleic acid nucleotides include, but are not limited to, the following: U.S. Pat. Nos. 6,268,490; 6,670,461; 6,794,499; 6,998,484; 7,053,207; 7,084,125; and 7,399,845, the entire contents of each of which are hereby incorporated herein by reference.

Potentially stabilizing modifications to the ends of RNA molecules can include N-(acetylaminocaproyl)-4-hydroxyprolinol (Hyp-C6-NHAc), N-(caproyl-4-hydroxyprolinol (Hyp-C6), N-(acetyl-4-hydroxyprolinol (Hyp-NHAc), thymidine-2'-0-deoxythymidine (ether), N-(aminocaproyl)-4-hydroxyprolinol (Hyp-C6-amino), 2-docosanoyl-uridine-3"-phosphate, inverted base dT(idT) and others. Disclosure of this modification can be found in PCT Publication No. WO 2011/005861.

Modified iRNAs Comprising Motifs of the Invention

In certain aspects of the invention, the double-stranded RNAi agents of the invention include agents with chemical modifications as disclosed, for example, in U.S. Provisional Application No. 61/561,710, filed on Nov. 18, 2011, or in PCT/US2012/065691, filed on Nov. 16, 2012, and published as WO2013075035 A1, the entire contents of each of which are incorporated herein by reference.

As shown herein and in Provisional Application No. 61/561,710, a superior result may be obtained by introducing one or more motifs of three identical modifications on three consecutive nucleotides into a sense strand and/or antisense strand of a RNAi agent, particularly at or near the cleavage site. In some embodiments, the sense strand and antisense strand of the RNAi agent may otherwise be completely modified. The introduction of these motifs interrupts the modification pattern, if present, of the sense and/or antisense strand. The RNAi agent may be optionally conjugated with a GalNAc derivative ligand, for instance on the sense strand. The resulting RNAi agents present superior gene silencing activity.

More specifically, it has been surprisingly discovered that when the sense strand and antisense strand of the double-stranded RNAi agent are modified to have one or more motifs of three identical modifications on three consecutive nucleotides at or near the cleavage site of at least one strand of an RNAi agent, the gene silencing activity of the RNAi agent was superiorly enhanced.

In one embodiment, the RNAi agent is a double ended bluntmer of 19 nucleotides in length, wherein the sense strand contains at least one motif of three 2'-F modifications on three consecutive nucleotides at positions 7, 8, 9 from the 5'end. The antisense strand contains at least one motif of three 2'-O-methyl modifications on three consecutive nucleotides at positions 11, 12, 13 from the 5'end.

In another embodiment, the RNAi agent is a double ended bluntmer of 20 nucleotides in length, wherein the sense strand contains at least one motif of three 2'-F modifications on three consecutive nucleotides at positions 8, 9, 10 from the 5'end. The antisense strand contains at least one motif of three 2'-O-methyl modifications on three consecutive nucleotides at positions 11, 12, 13 from the 5'end.

In yet another embodiment, the RNAi agent is a double ended bluntmer of 21 nucleotides in length, wherein the sense strand contains at least one motif of three 2'-F modifications on three consecutive nucleotides at positions 9, 10, 11 from the 5'end. The antisense strand contains at least one motif of three 2'-O-methyl modifications on three consecutive nucleotides at positions 11, 12, 13 from the 5'end.

In one embodiment, the RNAi agent comprises a 21 nucleotide sense strand and a 23 nucleotide antisense strand, wherein the sense strand contains at least one motif of three 2'-F modifications on three consecutive nucleotides at positions 9, 10, 11 from the 5'end; the antisense strand contains at least one motif of three 2'-O-methyl modifications on three consecutive nucleotides at positions 11, 12, 13 from the 5'end, wherein one end of the RNAi agent is blunt, while the other end comprises a 2 nucleotide overhang. Preferably, the 2 nucleotide overhang is at the 3'-end of the antisense strand. When the 2 nucleotide overhang is at the 3'-end of the antisense strand, there may be two phosphorothioate internucleotide linkages between the terminal three nucleotides, wherein two of the three nucleotides are the overhang nucleotides, and the third nucleotide is a paired nucleotide next to the overhang nucleotide. In one embodiment, the RNAi agent additionally has two phosphorothioate internucleotide linkages between the terminal three nucleotides at both the 5'-end of the sense strand and at the 5'-end of the antisense strand. In one embodiment, every nucleotide in the sense strand and the antisense strand of the RNAi agent, including the nucleotides that are part of the motifs are modified nucleotides. In one embodiment each residue is independently modified with a 2'-O-methyl or 3'-fluoro, e.g., in an alternating motif. Optionally, the RNAi agent further comprises a ligand (preferably GalNAc$_3$).

In one embodiment, the RNAi agent comprises sense and antisense strands, wherein the RNAi agent comprises a first strand having a length which is at least 25 and at most 29 nucleotides and a second strand having a length which is at most 30 nucleotides with at least one motif of three 2'-O-methyl modifications on three consecutive nucleotides at position 11, 12, 13 from the 5' end; wherein the 3' end of the first strand and the 5' end of the second strand form a blunt end and the second strand is 1-4 nucleotides longer at its 3' end than the first strand, wherein the duplex region which is at least 25 nucleotides in length, and the second strand is sufficiently complementary to a target mRNA along at least 19 nucleotide of the second strand length to reduce target gene expression when the RNAi agent is introduced into a mammalian cell, and wherein dicer cleavage of the RNAi agent preferentially results in an siRNA comprising the 3' end of the second strand, thereby reducing expression of the target gene in the mammal. Optionally, the RNAi agent further comprises a ligand.

In one embodiment, the sense strand of the RNAi agent contains at least one motif of three identical modifications on three consecutive nucleotides, where one of the motifs occurs at the cleavage site in the sense strand.

In one embodiment, the antisense strand of the RNAi agent can also contain at least one motif of three identical modifications on three consecutive nucleotides, where one of the motifs occurs at or near the cleavage site in the antisense strand For an RNAi agent having a duplex region of 17-23 nucleotides in length, the cleavage site of the antisense strand is typically around the 10, 11 and 12 positions from the 5'-end. Thus the motifs of three identical modifications may occur at the 9, 10, 11 positions; 10, 11, 12 positions; 11, 12, 13 positions; 12, 13, 14 positions; or 13, 14, 15 positions of the antisense strand, the count starting from the 1$^{st}$ nucleotide from the 5'-end of the antisense strand, or, the count starting from the 1$^{st}$ paired nucleotide within the duplex region from the 5'-end of the antisense strand. The cleavage site in the antisense strand may also change according to the length of the duplex region of the RNAi from the 5'-end.

The sense strand of the RNAi agent may contain at least one motif of three identical modifications on three consecutive nucleotides at the cleavage site of the strand; and the antisense strand may have at least one motif of three identical modifications on three consecutive nucleotides at or near the cleavage site of the strand. When the sense strand and the antisense strand form a dsRNA duplex, the sense strand and the antisense strand can be so aligned that one motif of the three nucleotides on the sense strand and one motif of the three nucleotides on the antisense strand have at least one nucleotide overlap, i.e., at least one of the three nucleotides of the motif in the sense strand forms a base pair with at least one of the three nucleotides of the motif in the antisense strand. Alternatively, at least two nucleotides may overlap, or all three nucleotides may overlap.

In one embodiment, the sense strand of the RNAi agent may contain more than one motif of three identical modifications on three consecutive nucleotides. The first motif may occur at or near the cleavage site of the strand and the other motifs may be a wing modification. The term "wing modification" herein refers to a motif occurring at another portion of the strand that is separated from the motif at or near the cleavage site of the same strand. The wing modification is either adjacent to the first motif or is separated by at least one or more nucleotides. When the motifs are immediately adjacent to each other than the chemistry of the motifs are distinct from each other and when the motifs are separated by one or more nucleotide than the chemistries can be the same or different. Two or more wing modifications may be present. For instance, when two wing modifications are present, each wing modification may occur at one end relative to the first motif which is at or near cleavage site or on either side of the lead motif.

Like the sense strand, the antisense strand of the RNAi agent may contain more than one motifs of three identical modifications on three consecutive nucleotides, with at least one of the motifs occurring at or near the cleavage site of the strand. This antisense strand may also contain one or more wing modifications in an alignment similar to the wing modifications that may be present on the sense strand.

In one embodiment, the wing modification on the sense strand or antisense strand of the RNAi agent typically does not include the first one or two terminal nucleotides at the 3'-end, 5'-end or both ends of the strand.

In another embodiment, the wing modification on the sense strand or antisense strand of the RNAi agent typically does not include the first one or two paired nucleotides within the duplex region at the 3'-end, 5'-end or both ends of the strand.

When the sense strand and the antisense strand of the RNAi agent each contain at least one wing modification, the wing modifications may fall on the same end of the duplex region, and have an overlap of one, two or three nucleotides.

When the sense strand and the antisense strand of the RNAi agent each contain at least two wing modifications, the sense strand and the antisense strand can be so aligned that two modifications each from one strand fall on one end of the duplex region, having an overlap of one, two or three nucleotides; two modifications each from one strand fall on the other end of the duplex region, having an overlap of one, two or three nucleotides; two modifications one strand fall on each side of the lead motif, having an overlap of one, two or three nucleotides in the duplex region.

In one embodiment, every nucleotide in the sense strand and antisense strand of the RNAi agent, including the nucleotides that are part of the motifs, may be modified. Each nucleotide may be modified with the same or different modification which can include one or more alteration of one or both of the non-linking phosphate oxygens and/or of one or more of the linking phosphate oxygens; alteration of a constituent of the ribose sugar, e.g., of the 2' hydroxyl on the ribose sugar; wholesale replacement of the phosphate moiety with "dephospho" linkers; modification or replacement of a naturally occurring base; and replacement or modification of the ribose-phosphate backbone.

As nucleic acids are polymers of subunits, many of the modifications occur at a position which is repeated within a nucleic acid, e.g., a modification of a base, or a phosphate moiety, or a non-linking O of a phosphate moiety. In some cases the modification will occur at all of the subject positions in the nucleic acid but in many cases it will not. By way of example, a modification may only occur at a 3' or 5' terminal position, may only occur in a terminal region, e.g., at a position on a terminal nucleotide or in the last 2, 3, 4, 5, or 10 nucleotides of a strand. A modification may occur in a double strand region, a single strand region, or in both. A modification may occur only in the double strand region of a RNA or may only occur in a single strand region of a RNA. For example, a phosphorothioate modification at a non-linking O position may only occur at one or both termini, may only occur in a terminal region, e.g., at a position on a terminal nucleotide or in the last 2, 3, 4, 5, or 10 nucleotides of a strand, or may occur in double strand and single strand regions, particularly at termini. The 5' end or ends can be phosphorylated.

It may be possible, e.g., to enhance stability, to include particular bases in overhangs, or to include modified nucleotides or nucleotide surrogates, in single strand overhangs, e.g., in a 5' or 3' overhang, or in both. For example, it can be desirable to include purine nucleotides in overhangs. In some embodiments all or some of the bases in a 3' or 5' overhang may be modified, e.g., with a modification described herein. Modifications can include, e.g., the use of modifications at the 2' position of the ribose sugar with modifications that are known in the art, e.g., the use of deoxyribonucleotides, 2'-deoxy-2'-fluoro (2'-F) or 2'-O-methyl modified instead of the ribosugar of the nucleobase, and modifications in the phosphate group, e.g., phosphorothioate modifications. Overhangs need not be homologous with the target sequence.

In one embodiment, each residue of the sense strand and antisense strand is independently modified with LNA, HNA, CeNA, 2'-methoxyethyl, 2'-O-methyl, 2'-O-allyl, 2'-C-allyl, 2'-deoxy, 2'-hydroxyl, or 2'-fluoro. The strands can contain more than one modification. In one embodiment, each residue of the sense strand and antisense strand is independently modified with 2'-O-methyl or 2'-fluoro.

At least two different modifications are typically present on the sense strand and antisense strand. Those two modifications may be the 2'-O-methyl or 2'-fluoro modifications, or others.

In one embodiment, the $N_a$ and/or $N_b$ comprise modifications of an alternating pattern. The term "alternating motif" as used herein refers to a motif having one or more modifications, each modification occurring on alternating nucleotides of one strand. The alternating nucleotide may refer to one per every other nucleotide or one per every three nucleotides, or a similar pattern. For example, if A, B and C each represent one type of modification to the nucleotide, the alternating motif can be "ABABABABABABABAB . . . ," "AABBAABBAABB . . . ," "AABAABAABAAB . . . ," "AAABAAABAAAB . . . ," "AAABBBAAABBB . . . ," or "ABCABCABCABC . . . ," etc.

The type of modifications contained in the alternating motif may be the same or different. For example, if A, B, C, D each represent one type of modification on the nucleotide, the alternating pattern, i.e., modifications on every other nucleotide, may be the same, but each of the sense strand or antisense strand can be selected from several possibilities of modifications within the alternating motif such as "ABABAB . . . ". "ACACAC . . . " "BDBDBD . . . " or "CDCDCD . . . ," etc.

In one embodiment, the RNAi agent of the invention comprises the modification pattern for the alternating motif on the sense strand relative to the modification pattern for the alternating motif on the antisense strand is shifted. The shift may be such that the modified group of nucleotides of the sense strand corresponds to a differently modified group of nucleotides of the antisense strand and vice versa. For example, the sense strand when paired with the antisense strand in the dsRNA duplex, the alternating motif in the sense strand may start with "ABABAB" from 5'-3' of the strand and the alternating motif in the antisense strand may start with "BABABA" from 5'-3' of the strand within the duplex region. As another example, the alternating motif in the sense strand may start with "AABBAABB" from 5'-3' of the strand and the alternating motif in the antisense strand may start with "BBAABBAA" from 5'-3' of the strand within the duplex region, so that there is a complete or partial shift of the modification patterns between the sense strand and the antisense strand.

In one embodiment, the RNAi agent comprises the pattern of the alternating motif of 2'-O-methyl modification and 2'-F modification on the sense strand initially has a shift relative to the pattern of the alternating motif of 2'-O-methyl modification and 2'-F modification on the antisense strand initially, i.e., the 2'-O-methyl modified nucleotide on the sense strand base pairs with a 2'-F modified nucleotide on the antisense strand and vice versa. The 1 position of the sense strand may start with the 2'-F modification, and the 1 position of the antisense strand may start with the 2'-O-methyl modification.

The introduction of one or more motifs of three identical modifications on three consecutive nucleotides to the sense strand and/or antisense strand interrupts the initial modification pattern present in the sense strand and/or antisense strand. This interruption of the modification pattern of the sense and/or antisense strand by introducing one or more motifs of three identical modifications on three consecutive nucleotides to the sense and/or antisense strand surprisingly enhances the gene silencing activity to the target gene.

In one embodiment, when the motif of three identical modifications on three consecutive nucleotides is introduced to any of the strands, the modification of the nucleotide next to the motif is a different modification than the modification of the motif. For example, the portion of the sequence containing the motif is " . . . $N_a$YYY$N_b$ . . . ," where "Y" represents the modification of the motif of three identical modifications on three consecutive nucleotide, and "$N_a$" and "$N_b$" represent a modification to the nucleotide next to the motif "YYY" that is different than the modification of Y, and where $N_a$ and $N_b$ can be the same or different modifications. Alternatively, $N_a$ and/or $N_b$ may be present or absent when there is a wing modification present.

The RNAi agent may further comprise at least one phosphorothioate or methylphosphonate internucleotide linkage. The phosphorothioate or methylphosphonate internucleotide linkage modification may occur on any nucleotide of the sense strand or antisense strand or both strands in any position of the strand. For instance, the internucleotide linkage modification may occur on every nucleotide on the sense strand and/or antisense strand; each internucleotide linkage modification may occur in an alternating pattern on the sense strand and/or antisense strand; or the sense strand or antisense strand may contain both internucleotide linkage modifications in an alternating pattern. The alternating pattern of the internucleotide linkage modification on the sense strand may be the same or different from the antisense strand, and the alternating pattern of the internucleotide linkage modification on the sense strand may have a shift relative to the alternating pattern of the internucleotide linkage modification on the antisense strand.

In one embodiment, the RNAi comprises a phosphorothioate or methylphosphonate internucleotide linkage modification in the overhang region. For example, the overhang region may contain two nucleotides having a phosphorothioate or methylphosphonate internucleotide linkage between the two nucleotides. Internucleotide linkage modifications also may be made to link the overhang nucleotides with the terminal paired nucleotides within the duplex region. For example, at least 2, 3, 4, or all the overhang nucleotides may be linked through phosphorothioate or methylphosphonate internucleotide linkage, and optionally, there may be additional phosphorothioate or methylphosphonate internucleotide linkages linking the overhang nucleotide with a paired nucleotide that is next to the overhang nucleotide. For instance, there may be at least two phosphorothioate internucleotide linkages between the terminal three nucleotides, in which two of the three nucleotides are overhang nucleotides, and the third is a paired nucleotide next to the overhang nucleotide. These terminal three nucleotides may be at the 3'-end of the antisense strand, the 3'-end of the sense strand, the 5'-end of the antisense strand, and/or the 5'end of the antisense strand.

In one embodiment, the 2 nucleotide overhang is at the 3'-end of the antisense strand, and there are two phosphorothioate internucleotide linkages between the terminal three nucleotides, wherein two of the three nucleotides are the overhang nucleotides, and the third nucleotide is a paired nucleotide next to the overhang nucleotide. Optionally, the RNAi agent may additionally have two phosphorothioate internucleotide linkages between the terminal three nucleotides at both the 5'-end of the sense strand and at the 5'-end of the antisense strand.

In one embodiment, the RNAi agent comprises mismatch(es) with the target, within the duplex, or combinations thereof. The mismatch may occur in the overhang region or the duplex region. The base pair may be ranked on the basis of their propensity to promote dissociation or melting (e.g., on the free energy of association or dissociation of a particular pairing, the simplest approach is to examine the pairs on an individual pair basis, though next neighbor or similar analysis can also be used). In terms of promoting dissociation: A:U is preferred over G:C; G:U is preferred over G:C; and I:C is preferred over G:C (I=inosine). Mismatches, e.g., non-canonical or other than canonical pairings (as described elsewhere herein) are preferred over canonical (A:T, A:U, G:C) pairings; and pairings which include a universal base are preferred over canonical pairings.

In one embodiment, the RNAi agent comprises at least one of the first 1, 2, 3, 4, or 5 base pairs within the duplex regions from the 5'-end of the antisense strand independently selected from the group of: A:U, G:U, I:C, and mismatched pairs, e.g., non-canonical or other than canonical pairings or pairings which include a universal base, to promote the dissociation of the antisense strand at the 5'-end of the duplex.

In one embodiment, the nucleotide at the 1 position within the duplex region from the 5'-end in the antisense strand is selected from the group consisting of A, dA, dU, U, and dT. Alternatively, at least one of the first 1, 2 or 3 base pair within the duplex region from the 5'-end of the antisense strand is an AU base pair. For example, the first base pair within the duplex region from the 5'-end of the antisense strand is an AU base pair.

In one embodiment, the sense strand sequence may be represented by formula (I):

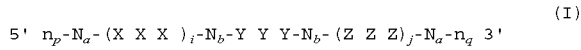

(I)

wherein:
i and j are each independently 0 or 1;
p and q are each independently 0-6;

each $N_a$ independently represents an oligonucleotide sequence comprising 0-25 modified nucleotides, each sequence comprising at least two differently modified nucleotides;

each $N_b$ independently represents an oligonucleotide sequence comprising 0-10 modified nucleotides;

each $n_p$ and $n_q$ independently represent an overhang nucleotide:

wherein Nb and Y do not have the same modification; and

XXX, YYY and ZZZ each independently represent one motif of three identical modifications on three consecutive nucleotides. Preferably YYY is all 2'-F modified nucleotides.

In one embodiment, the $N_a$ and/or $N_b$ comprise modifications of alternating pattern.

In one embodiment, the YYY motif occurs at or near the cleavage site of the sense strand. For example, when the RNAi agent has a duplex region of 17-23 nucleotides in length, the YYY motif can occur at or the vicinity of the cleavage site (e.g.: can occur at positions 6, 7, 8, 7, 8, 9, 8, 9, 10, 9, 10, 11, 10, 11, 12 or 11, 12, 13) of—the sense strand, the count starting from the $1^{st}$ nucleotide, from the 5'-end; or optionally, the count starting at the $1^{st}$ paired nucleotide within the duplex region, from the 5'-end.

In one embodiment, i is 1 and j is 0, or i is 0 and j is 1, or both i and j are 1. The sense strand can therefore be represented by the following formulas:

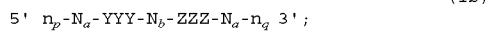
(Ib)

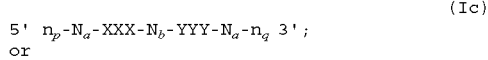
(Ic)
or

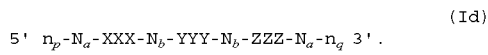
(Id)

When the sense strand is represented by formula (Ib), $N_b$ represents an oligonucleotide sequence comprising 0-10, 0-7, 0-5, 0-4, 0-2 or 0 modified nucleotides. Each $N_a$ independently can represent an oligonucleotide sequence comprising 2-20, 2-15, or 2-10 modified nucleotides.

When the sense strand is represented as formula (Ic), $N_b$ represents an oligonucleotide sequence comprising 0-10, 0-7, 0-10, 0-7, 0-5, 0-4, 0-2 or 0 modified nucleotides. Each $N_z$ can independently represent an oligonucleotide sequence comprising 2-20, 2-15, or 2-10 modified nucleotides.

When the sense strand is represented as formula (Id), each $N_b$ independently represents an oligonucleotide sequence comprising 0-10, 0-7, 0-5, 0-4, 0-2 or 0 modified nucleotides. Preferably, $N_b$ is 0, 1, 2, 3, 4, 5 or 6 Each $N_a$ can independently represent an oligonucleotide sequence comprising 2-20, 2-15, or 2-10 modified nucleotides.

Each of X, Y and Z may be the same or different from each other.

In other embodiments, i is 0 and j is 0, and the sense strand may be represented by the formula:

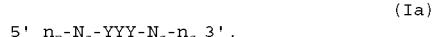
(Ia)

When the sense strand is represented by formula (Ia), each $N_a$ independently can represent an oligonucleotide sequence comprising 2-20, 2-15, or 2-10 modified nucleotides.

In one embodiment, the antisense strand sequence of the RNAi may be represented by formula (II):

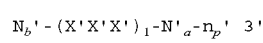
(II)

wherein:

k and l are each independently 0 or 1;

p' and q' are each independently 0-6;

each $N_a'$ independently represents an oligonucleotide sequence comprising 0-25 modified nucleotides, each sequence comprising at least two differently modified nucleotides;

each $N_b'$ independently represents an oligonucleotide sequence comprising 0-10 modified nucleotides;

each $n_p'$ and $n_q'$ independently represent an overhang nucleotide;

wherein $N_b'$ and Y' do not have the same modification; and

X'X'X', Y'Y'Y' and Z'Z'Z' each independently represent one motif of three identical modifications on three consecutive nucleotides.

In one embodiment, the $N_a'$ and/or $N_b'$ comprise modifications of alternating pattern.

The Y'Y'Y' motif occurs at or near the cleavage site of the antisense strand. For example, when the RNAi agent has a duplex region of 17-23 nucleotide in length, the Y'Y'Y' motif can occur at positions 9, 10, 11; 10, 11, 12; 11, 12, 13; 12, 13, 14; or 13, 14, 15 of the antisense strand, with the count starting from the $1^{st}$ nucleotide, from the 5'-end; or optionally, the count starting at the $1^{st}$ paired nucleotide within the duplex region, from the 5'-end. Preferably, the Y'Y'Y' motif occurs at positions 11, 12, 13.

In one embodiment. Y'Y'Y' motif is all 2'-OMe modified nucleotides.

In one embodiment, k is 1 and l is 0, or k is 0 and l is 1, or both k and l are 1.

The antisense strand can therefore be represented by the following formulas:

(IIb)

(IIc)
or

(IId)

When the antisense strand is represented by formula (IIb), $N_b$ represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides.

When the antisense strand is represented as formula (IIc), $N_b'$ represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides.

When the antisense strand is represented as formula (IId), each $N_b'$ independently represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides. Preferably, $N_b$ is 0, 1, 2, 3, 4, 5 or 6.

In other embodiments, k is 0 and l is 0 and the antisense strand may be represented by the formula:

 (Ia)

When the antisense strand is represented as formula (IIa), each $N_a'$ independently represents an oligonucleotide sequence comprising 2-20, 2-15, or 2-10 modified nucleotides.

Each of X', Y' and Z' may be the same or different from each other.

Each nucleotide of the sense strand and antisense strand may be independently modified with LNA, HNA, CeNA, 2'-methoxyethyl, 2'-O-methyl, 2'-O-allyl, 2'-C-allyl, 2'-hydroxyl, or 2'-fluoro. For example, each nucleotide of the sense strand and antisense strand is independently modified with 2'-O-methyl or 2'-fluoro. Each X, Y, Z, X', Y' and Z', in particular, may represent a 2'-O-methyl modification or a 2'-fluoro modification.

In one embodiment, the sense strand of the RNAi agent may contain YYY motif occurring at 9, 10 and 11 positions of the strand when the duplex region is 21 nt, the count starting from the 1st nucleotide from the 5'-end, or optionally, the count starting at the 1st paired nucleotide within the duplex region, from the 5'-end; and Y represents 2'-F modification. The sense strand may additionally contain XXX motif or ZZZ motifs as wing modifications at the opposite end of the duplex region; and XXX and ZZZ each independently represents a 2'-OMe modification or 2'-F modification.

In one embodiment the antisense strand may contain Y'Y'Y' motif occurring at positions 11, 12, 13 of the strand, the count starting from the 1st nucleotide from the 5'-end, or optionally, the count starting at the 1st paired nucleotide within the duplex region, from the 5'-end; and Y' represents 2'-O-methyl modification. The antisense strand may additionally contain X'X'X' motif or Z'Z'Z' motifs as wing modifications at the opposite end of the duplex region; and X'X'X' and Z'Z'Z' each independently represents a 2'-OMe modification or 2'-F modification.

The sense strand represented by any one of the above formulas (Ia), (Ib), (Ic), and (Id) forms a duplex with an antisense strand being represented by any one of formulas (IIa), (IIb), (IIc), and (IId), respectively.

Accordingly, the RNAi agents for use in the methods of the invention may comprise a sense strand and an antisense strand, each strand having 14 to 30 nucleotides, the RNAi duplex represented by formula (III):

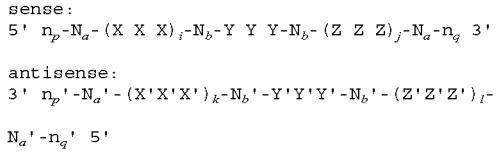 (III)

wherein:
i, j, k, and l are each independently 0 or 1:
p, p', q, and q' are each independently 0-6;
each $N_a$ and $N_a$ independently represents an oligonucleotide sequence comprising 0-modified nucleotides, each sequence comprising at least two differently modified nucleotides;

each $N_b$ and $N_b'$ independently represents an oligonucleotide sequence comprising 0-10 modified nucleotides;
wherein
each $n_p'$, $n_p$, $n_q'$, and $n_q$, each of which may or may not be present, independently represents an overhang nucleotide; and XXX, YYY, ZZZ, X'X'X', Y'Y'Y', and Z'Z'Z' each independently represent one motif of three identical modifications on three consecutive nucleotides.

In one embodiment, i is 0 and j is 0; or i is 1 and j is 0; or i is 0 and j is 1; or both i and j are 0; or both i and j are 1. In another embodiment, k is 0 and l is 0; or k is 1 and l is 0; k is 0 and l is 1; or both k and l are 0; or both k and l are 1.

Exemplary combinations of the sense strand and antisense strand forming a RNAi duplex include the formulas below:

 (IIIa)

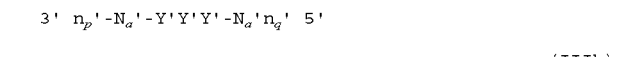 (IIIb)

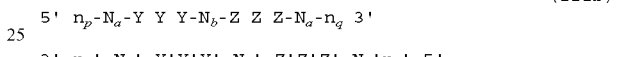

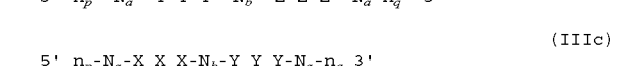 (IIIc)

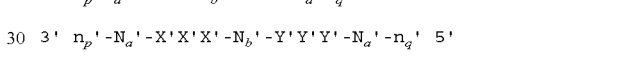

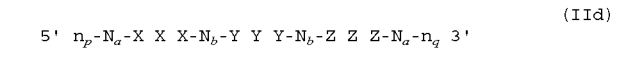 (IId)

When the RNAi agent is represented by formula (IIIa), each $N_a$ independently represents an oligonucleotide sequence comprising 2-20, 2-15, or 2-10 modified nucleotides.

When the RNAi agent is represented by formula (IIIb), each $N_b$ independently represents an oligonucleotide sequence comprising 1-10, 1-7, 1-5 or 1-4 modified nucleotides. Each $N_a$ independently represents an oligonucleotide sequence comprising 2-20, 2-15, or 2-10 modified nucleotides.

When the RNAi agent is represented as formula (IIIc), each $N_b$, $N_b'$ independently represents an oligonucleotide sequence comprising 0-10, 0-7, 0-10, 0-7, 0-5, 0-4, 0-2 or 0 modified nucleotides. Each $N_a$ independently represents an oligonucleotide sequence comprising 2-20, 2-15, or 2-10 modified nucleotides.

When the RNAi agent is represented as formula (IIId), each $N_b$, $N_b'$ independently represents an oligonucleotide sequence comprising 0-10, 0-7, 0-10, 0-7, 0-5, 0-4, 0-2 or 0 modified nucleotides. Each $N_a$, $N_a$ independently represents an oligonucleotide sequence comprising 2-20, 2-15, or 2-10 modified nucleotides. Each of $N_a$, $N_a'$, $N_b$ and $N_b$ independently comprises modifications of alternating pattern.

Each of X, Y and Z in formulas (III), (IIIa), (IIIb), (IIIc), and (IIId) may be the same or different from each other.

When the RNAi agent is represented by formula (III), (IIIa), (IIIb), (IIIc), and (IIId), at least one of the Y nucleotides may form a base pair with one of the Y' nucleotides. Alternatively, at least two of the Y nucleotides form base pairs with the corresponding Y' nucleotides; or all three of the Y nucleotides all form base pairs with the corresponding Y' nucleotides.

When the RNAi agent is represented by formula (IIIb) or (IIId), at least one of the Z nucleotides may form a base pair with one of the Z' nucleotides. Alternatively, at least two of the Z nucleotides form base pairs with the corresponding Z' nucleotides; or all three of the Z nucleotides all form base pairs with the corresponding Z' nucleotides.

When the RNAi agent is represented as formula (IIIc) or (IIId), at least one of the X nucleotides may form a base pair with one of the X' nucleotides. Alternatively, at least two of the X nucleotides form base pairs with the corresponding X' nucleotides; or all three of the X nucleotides all form base pairs with the corresponding X' nucleotides.

In one embodiment, the modification on the Y nucleotide is different than the modification on the Y' nucleotide, the modification on the Z nucleotide is different than the modification on the Z' nucleotide, and/or the modification on the X nucleotide is different than the modification on the X' nucleotide.

In one embodiment, when the RNAi agent is represented by formula (IIId), the N, modifications are 2'-O-methyl or 2'-fluoro modifications. In another embodiment, when the RNAi agent is represented by formula (IIId), the $N_a$ modifications are 2'-O-methyl or 2'-fluoro modifications and $n_p'>0$ and at least one $n_p'$ is linked to a neighboring nucleotide a via phosphorothioate linkage. In yet another embodiment, when the RNAi agent is represented by formula (IIId), the $N_a$ modifications are 2'-O-methyl or 2'-fluoro modifications, $n_p'>0$ and at least one $n_p'$ is linked to a neighboring nucleotide via phosphorothioate linkage, and the sense strand is conjugated to one or more GalNAc derivatives attached through a bivalent or trivalent branched linker. In another embodiment, when the RNAi agent is represented by formula (IIId), the $N_a$ modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In one embodiment, when the RNAi agent is represented by formula (IIIa), the $N_a$ modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In one embodiment, the RNAi agent is a multimer containing at least two duplexes represented by formula (III), (IIIa), (IIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, the RNAi agent is a multimer containing three, four, five, six or more duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, two RNAi agents represented by formula (III), (IIIa), (IIIb), (IIIc), and (IIId) are linked to each other at the 5' end, and one or both of the 3' ends and are optionally conjugated to a ligand. Each of the agents can target the same gene or two different genes; or each of the agents can target same gene at two different target sites.

Various publications describe multimeric RNAi agents that can be used in the methods of the invention. Such publications include WO2007/091269, U.S. Pat. No. 7,858,769. WO2010/141511, WO2007/117686. WO2009/014887 and WO2011/031520 the entire contents of each of which are hereby incorporated herein by reference.

The RNAi agent that contains conjugations of one or more carbohydrate moieties to a RNAi agent can optimize one or more properties of the RNAi agent. In many cases, the carbohydrate moiety will be attached to a modified subunit of the RNAi agent. For example, the ribose sugar of one or more ribonucleotide subunits of a dsRNA agent can be replaced with another moiety. e.g., a non-carbohydrate (preferably cyclic) carrier to which is attached a carbohydrate ligand. A ribonucleotide subunit in which the ribose sugar of the subunit has been so replaced is referred to herein as a ribose replacement modification subunit (RRMS). A cyclic carrier may be a carbocyclic ring system, i.e., all ring atoms are carbon atoms, or a heterocyclic ring system, i.e., one or more ring atoms may be a heteroatom, e.g., nitrogen, oxygen, sulfur. The cyclic carrier may be a monocyclic ring system, or may contain two or more rings, e.g. fused rings. The cyclic carrier may be a fully saturated ring system, or it may contain one or more double bonds.

The ligand may be attached to the polynucleotide via a carrier. The carriers include (i) at least one "backbone attachment point," preferably two "backbone attachment points" and (ii) at least one "tethering attachment point." A "backbone attachment point" as used herein refers to a functional group, e.g. a hydroxyl group, or generally, a bond available for, and that is suitable for incorporation of the carrier into the backbone, e.g., the phosphate, or modified phosphate, e.g., sulfur containing, backbone, of a ribonucleic acid. A "tethering attachment point" (TAP) in some embodiments refers to a constituent ring atom of the cyclic carrier, e.g., a carbon atom or a heteroatom (distinct from an atom which provides a backbone attachment point), that connects a selected moiety. The moiety can be, e.g., a carbohydrate, e.g. monosaccharide, disaccharide, trisaccharide, tetrasaccharide, oligosaccharide and polysaccharide. Optionally, the selected moiety is connected by an intervening tether to the cyclic carrier. Thus, the cyclic carrier will often include a functional group, e.g., an amino group, or generally, provide a bond, that is suitable for incorporation or tethering of another chemical entity, e.g., a ligand to the constituent ring.

The RNAi agents may be conjugated to a ligand via a carrier, wherein the carrier can be cyclic group or acyclic group; preferably, the cyclic group is selected from pyrrolidinyl, pyrazolinyl, pyrazolidinyl, imidazolinyl, imidazolidinyl, piperidinyl, piperazinyl, [1,3]dioxolane, oxazolidinyl, isoxazolidinyl, morpholinyl, thiazolidinyl, isothiazolidinyl, quinoxalinyl, pyridazinonyl, tetrahydrofuryl and decalin; preferably, the acyclic group is selected from serinol backbone or diethanolamine backbone.

In certain specific embodiments, the RNAi agent for use in the methods of the invention is an agent selected from the group of agents listed in any one of Tables 1 and 2. In one embodiment, when the agent is an agent listed in Table 1, the agent may lack a terminal dT.

The present invention further includes double-stranded RNAi agents comprising any one of the sequences listed in any one of Tables 1 or 2 which comprise a 5' phosphate or phosphate mimetic on the antisense strand (see, e.g., PCT Publication No. WO 2011005860). Further, the present invention includes double-stranded RNAi agents comprising any one of the sequences listed in any one of Tables 1 or 2 which include a 2'fluoro group in place of a 2'-OMe group at the 5'end of the sense strand.

Additional Motifs

In certain aspects, the double-stranded RNAi agents described herein comprises a sense strand and an antisense strand wherein said sense strand and an antisense strand comprise less than eleven, ten, nine, eight, seven, six, or five 2'-deoxyflouro.

In certain aspects, the double-stranded RNAi agents described herein comprises a sense strand and an antisense strand, wherein said sense strand and an antisense strand comprise less than ten, nine, eight, seven, six, five, four phosphorothioate internucleotide linkages.

In certain aspects, the double-stranded RNAi agents described herein comprises a sense strand and an antisense strand, wherein said sense strand and an antisense strand comprise less than ten 2'-deoxyflouro and less than six phosphorothioate internucleotide linkages.

In certain aspects, the double-stranded RNAi agents described herein comprises a sense strand and an antisense strand, wherein said sense strand and an antisense strand comprise less than eight 2'-deoxyflouro and less than six phosphorothioate internucleotide linkages.

In certain aspects, the double-stranded RNAi agents described herein comprises a sense strand and an antisense strand, wherein said sense strand and an antisense strand comprise less than nine 2'-deoxyflouro and less than six phosphorothioate internucleotide linkages.

Ligands

The double-stranded RNAi agents of the invention may optionally be conjugated to one or more ligands. The ligand can be attached to the sense strand, antisense strand or both strands, at the 3'-end, 5'-end or both ends. For instance, the ligand may be conjugated to the sense strand. In some embodiments, the ligand is conjugated to the 3'-end of the sense strand. In one embodiment, the ligand is a GalNAc ligand. In particularly some embodiments, the ligand is GalNAc$_3$. The ligands are coupled, preferably covalently, either directly or indirectly via an intervening tether.

In some embodiments, a ligand alters the distribution, targeting or lifetime of the molecule into which it is incorporated. In some embodiments a ligand provides an enhanced affinity for a selected target, e.g., molecule, cell or cell type, compartment, receptor e.g., a cellular or organ compartment, tissue, organ or region of the body, as, e.g., compared to a species absent such a ligand. Ligands providing enhanced affinity for a selected target are also termed targeting ligands.

Some ligands can have endosomolytic properties. The endosomolytic ligands promote the lysis of the endosome and/or transport of the composition of the invention, or its components, from the endosome to the cytoplasm of the cell. The endosomolytic ligand may be a polyanionic peptide or peptidomimetic which shows pH-dependent membrane activity and fusogenicity. In one embodiment, the endosomolytic ligand assumes its active conformation at endosomal pH. The "active" conformation is that conformation in which the endosomolytic ligand promotes lysis of the endosome and/or transport of the composition of the invention, or its components, from the endosome to the cytoplasm of the cell. Exemplary endosomolytic ligands include the GALA peptide (Subbarao et al., *Biochemistry*, 1987, 26: 2964-2972), the EALA peptide (Vogel et al., *J. Am. Chem. Soc.*, 1996, 118: 1581-1586), and their derivatives (Turk et al., *Biochem. Biophys. Acta*, 2002, 1559: 56-68). In one embodiment, the endosomolytic component may contain a chemical group (e.g., an amino acid) which will undergo a change in charge or protonation in response to a change in pH. The endosomolytic component may be linear or branched.

Ligands can improve transport, hybridization, and specificity properties and may also improve nuclease resistance of the resultant natural or modified oligoribonucleotide, or a polymeric molecule comprising any combination of monomers described herein and/or natural or modified ribonucleotides.

Ligands in general can include therapeutic modifiers, e.g., for enhancing uptake; diagnostic compounds or reporter groups e.g., for monitoring distribution; cross-linking agents; and nuclease-resistance conferring moieties. General examples include lipids, steroids, vitamins, sugars, proteins, peptides, polyamines, and peptide mimics.

Ligands can include a naturally occurring substance, such as a protein (e.g., human serum albumin (HSA), low-density lipoprotein (LDL), high-density lipoprotein (HDL), or globulin); a carbohydrate (e.g., a dextran, pullulan, chitin, chitosan, inulin, cyclodextrin or hyaluronic acid); or a lipid. The ligand may also be a recombinant or synthetic molecule, such as a synthetic polymer, e.g., a synthetic polyamino acid, an oligonucleotide (e.g., an aptamer). Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly(2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Ligands can also include targeting groups, e.g., a cell or tissue targeting agent. e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-gulucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, biotin, an RGD peptide, an RGD peptide mimetic or an aptamer.

Other examples of ligands include dyes, intercalating agents (e.g., acridines), cross-linkers (e.g., psoralene, mitomycin C), porphyrins (TPPC4, texaphyrin, Sapphyrin), polycyclic aromatic hydrocarbons (e.g., phenazine, dihydrophenazine), artificial endonucleases or a chelator (e.g., EDTA), lipophilic molecules, e.g., cholesterol, cholic acid, adamantane acetic acid, 1-pyrene butyric acid, dihydrotestosterone, 1,3-Bis-O(hexadecyl)glycerol, geranyloxyhexyl group, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, [MPEG]$_2$, polyamino, alkyl, substituted alkyl, radiolabeled markers, enzymes, haptens (e.g., biotin), transportiabsorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a cancer cell, endothelial cell, or bone cell. Ligands may also include hormones and hormone receptors. They can also include non-peptidic species, such as lipids, lectins, carbohydrates, vitamins, cofactors, multivalent lactose, multivalent galactose, N-acetyl-galactosamine, N-acetyl-gulucosamine multivalent mannose, multivalent fucose, or aptamers. The ligand can be, for example, a lipopolysaccharide, an activator of p38 MAP kinase, or an activator of NF-κB.

The ligand can be a substance. e.g., a drug, which can increase the uptake of the iRNA agent into the cell, for example, by disrupting the cell's cytoskeleton, e.g., by disrupting the cell's microtubules, microfilaments, and/or intermediate filaments. The drug can be, for example, taxon, vincristine, vinblastine, cytochalasin, nocodazole, japlakinolide, latrunculin A, phalloidin, swinholide A, indanocine, or myoservin.

The ligand can increase the uptake of the oligonucleotide into the cell by, for example, activating an inflammatory response. Exemplary ligands that would have such an effect include tumor necrosis factor alpha (TNFalpha), interleukin-1 beta, or gamma interferon.

In one aspect, the ligand is a lipid or lipid-based molecule. Such a lipid or lipid-based molecule preferably binds a serum protein, e.g., human serum albumin (HSA). An HSA binding ligand allows for distribution of the conjugate to a target tissue, e.g., a non-kidney target tissue of the body. For example, the target tissue can be the liver, including parenchymal cells of the liver. Other molecules that can bind HSA can also be used as ligands. For example, naproxen or aspirin can be used. A lipid or lipid-based ligand can (a) increase resistance to degradation of the conjugate, (b) increase targeting or transport into a target cell or cell membrane, and/or (c) can be used to adjust binding to a serum protein, e.g., HSA.

A lipid based ligand can be used to modulate, e.g., control the binding of the conjugate to a target tissue. For example, a lipid or lipid-based ligand that binds to HSA more strongly will be less likely to be targeted to the kidney and therefore less likely to be cleared from the body. A lipid or lipid-based ligand that binds to HSA less strongly can be used to target the conjugate to the kidney.

In one embodiment, the lipid based ligand binds HSA. Preferably, it binds HSA with a sufficient affinity such that the conjugate will be preferably distributed to a non-kidney tissue. In one embodiment, the affinity is such that that the HSA-ligand binding can be reversed. In another embodiment, the lipid based ligand binds HSA weakly or not at all, such that the conjugate will be preferably distributed to the kidney. Other moieties that target to kidney cells can also be used in place of or in addition to the lipid based ligand.

In another aspect, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include B vitamins, e.g., folic acid, B12, riboflavin, biotin, pyridoxal or other vitamins or nutrients taken up by cancer cells. Also included are HAS, low density lipoprotein (LDL) and high-density lipoprotein (HDL).

In another aspect, the ligand is a cell-permeation agent, preferably a helical cell-permeation agent. Preferably, the agent is amphipathic. An exemplary agent is a peptide such as tat or antennopedia. If the agent is a peptide, it can be modified, including a peptidylmimetic, invertomers, non-peptide or pseudo-peptide linkages, and use of D-amino acids. The helical agent is preferably an alpha-helical agent, which preferably has a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The peptide or peptidomimetic moiety can be about 5-50 amino acids long, e.g., about 5, 10, 15, 20, 25, 30, 35, 40, 45, or 50 amino acids long. A peptide or peptidomimetic can be, for example, a cell permeation peptide, cationic peptide, amphipathic peptide, or hydrophobic peptide (e.g., consisting primarily of Tyr, Trp or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVL-LALLAP (SEQ ID NO: 9). An RFGF analogue (e.g., amino acid sequence AALLPVLLAAP (SEQ ID NO: 10)) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ) (SEQ ID NO: 11) and the *Drosophila* Antennapedia protein (RQIKI-WFQNRRMKWKK) (SEQ ID NO: 12) have been found to be capable of functioning as delivery peptides. A peptide or peptidomimetic can be encoded by a random sequence of DNA, such as a peptide identified from a phage-display library, or one-bead-one-compound (OBOC) combinatorial library (Lam et al., *Nature*, 354:82-84, 1991). Preferably the peptide or peptidomimetic tethered to an iRNA agent via an incorporated monomer unit is a cell targeting peptide such as an arginine-glycine-aspartic acid (RGD)-peptide, or ROD mimic. A peptide moiety can range in length from about 5 amino acids to about 40 amino acids. The peptide moieties can have a structural modification, such as to increase stability or direct conformational properties. Any of the structural modifications described below can be utilized. An RGD peptide moiety can be used to target a tumor cell, such as an endothelial tumor cell or a breast cancer tumor cell (Zitzmann et al., *Cancer Res.*, 62:5139-43, 2002). An RGD peptide can facilitate targeting of an iRNA agent to tumors of a variety of other tissues, including the lung, kidney, spleen, or liver (Aoki et al., *Cancer Gene Therapy* 8:783-787, 2001). Preferably, the RGD peptide will facilitate targeting of an iRNA agent to the kidney. The RGD peptide can be linear or cyclic, and can be modified, e.g., glycosylated or methylated to facilitate targeting to specific tissues. For example, a glycosylated RGD peptide can deliver an iRNA agent to a tumor cell expressing $\alpha_v\beta_3$ (Haubner et al., *Jour. Nucl. Med.*, 42:326-336, 2001). Peptides that target markers enriched in proliferating cells can be used. For example, RGD containing peptides and peptidomimetics can target cancer cells, in particular cells that exhibit an integrin. Thus, one could use RGD peptides, cyclic peptides containing RGD, RGD peptides that include D-amino acids, as well as synthetic RGD mimics. In addition to RGD, one can use other moieties that target the integrin ligand. Generally, such ligands can be used to control proliferating cells and angiogenesis. Some conjugates of this type of ligand target PECAM-1, VEGF, or other cancer gene, e.g., a cancer gene described herein.

A "cell permeation peptide" is capable of permeating a cell. e.g., a microbial cell, such as a bacterial or fungal cell, or a mammalian cell, such as a human cell. A microbial cell-permeating peptide can be, for example, an α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen (Simeoni et al., Nucl. Acids Res. 31:2717-2724, 2003).

In one embodiment, a targeting peptide can be an amphipathic α-helical peptide. Exemplary amphipathic α-helical peptides include, but are not limited to, cecropins, lycotoxins, paradaxins, buforin, CPF, bombinin-like peptide (BLP), cathelicidins, ceratotoxins, S. clava peptides, hagfish intestinal antimicrobial peptides (HFIAPs), magainines, brevinins-2, dermaseptins, melittins, pleurocidin, $H_2A$ peptides, Xenopus peptides, esculentinis-1, and caerins. A number of factors will preferably be considered to maintain the integrity of helix stability. For example, a maximum number of helix stabilization residues will be utilized (e.g., leu, ala, or lys), and a minimum number helix destabilization residues will be utilized (e.g., proline, or cyclic monomeric units. The capping residue will be considered (for example Gly is an exemplary N-capping residue and/or C-terminal amidation can be used to provide an extra H-bond to stabilize the helix. Formation of salt bridges between residues with opposite charges, separated by i±3, or i±4 positions can provide stability. For example, cationic residues such as lysine, arginine, homo-arginine, ornithine or histidine can form salt bridges with the anionic residues glutamate or aspartate.

Peptide and peptidomimetic ligands include those having naturally occurring or modified peptides, e.g., D or L peptides; α, β, or γ peptides; N-methyl peptides; azapeptides; peptides having one or more amide. i.e., peptide, linkages replaced with one or more urea, thiourea, carbamate, or sulfonyl urea linkages; or cyclic peptides.

The targeting ligand can be any ligand that is capable of targeting a specific receptor. Examples are: folate. GalNAc, galactose, mannose, mannose-6P, clusters of sugars such as GalNAc cluster, mannose cluster, galactose cluster, or an aptamer. A cluster is a combination of two or more sugar units. The targeting ligands also include integrin receptor ligands, Chemokine receptor ligands, transferrin, biotin, serotonin receptor ligands. PSMA, endothelin, GCPII, somatostatin, LDL and HDL ligands. The ligands can also be based on nucleic acid, e.g., an aptamer. The aptamer can be unmodified or have any combination of modifications disclosed herein.

Endosomal release agents include imidazoles, poly or oligoimidazoles, PEIs, peptides, fusogenic peptides, polycaboxylates, polyacations, masked oligo or poly cations or anions, acetals, polyacetals, ketals/polyketyals, orthoesters, polymers with masked or unmasked cationic or anionic charges, dendrimers with masked or unmasked cationic or anionic charges.

PK modulator stands for pharmacokinetic modulator. PK modulators include lipophiles, bile acids, steroids, phospholipid analogues, peptides, protein binding agents, PEG, vitamins etc. Exemplary PK modulators include, but are not limited to, cholesterol, fatty acids, cholic acid, lithocholic acid, dialkylglycerides, diacylglyceride, phospholipids, sphingolipids, naproxen, ibuprofen, vitamin E, biotin etc. Oligonucleotides that comprise a number of phosphorothioate linkages are also known to bind to serum protein, thus short oligonucleotides, e.g., oligonucleotides of about 5 bases, 10 bases, 15 bases or 20 bases, comprising multiple phosphorothioate linkages in the backbone are also amenable to the present invention as ligands (e.g., as PK modulating ligands).

In addition, aptamers that bind serum components (e.g., serum proteins) are also amenable to the present invention as PK modulating ligands.

Other ligand conjugates amenable to the invention are described in U.S. patent applications Ser. No. 10/916,185, filed Aug. 10, 2004; U.S. Ser. No. 10/946,873, filed Sep. 21, 2004; U.S. Ser. No. 10/833,934, filed Aug. 3, 2007; U.S. Ser. No. 11/115,989 filed Apr. 27, 2005 and U.S. Ser. No. 11/944,227 filed Nov. 21, 2007, which are incorporated by reference in their entireties for all purposes.

When two or more ligands are present, the ligands can all have same properties, all have different properties or some ligands have the same properties while others have different properties. For example, a ligand can have targeting properties, have endosomolytic activity or have PK modulating properties. In one embodiment, all the ligands have different properties.

Ligands can be coupled to the oligonucleotides at various places, for example, 3'-end, 5'-end, and/or at an internal position. In some embodiments, the ligand is attached to the oligonucleotides via an intervening tether, e.g., a carrier described herein. The ligand or tethered ligand may be present on a monomer when the monomer is incorporated into the growing strand. In some embodiments, the ligand may be incorporated via coupling to a "precursor" monomer after the "precursor" monomer has been incorporated into the growing strand. For example, a monomer having, e.g., an amino-terminated tether (i.e., having no associated ligand), e.g., TAP-$(CH_2)_n NH_2$ may be incorporated into a growing oligonucleotides strand. In a subsequent operation, i.e., after incorporation of the precursor monomer into the strand, a ligand having an electrophilic group, e.g., a pentafluorophenyl ester or aldehyde group, can subsequently be attached to the precursor monomer by coupling the electrophilic group of the ligand with the terminal nucleophilic group of the precursor monomer's tether.

In another example, a monomer having a chemical group suitable for taking part in Click Chemistry reaction may be incorporated, e.g., an azide or alkyne terminated tether/linker. In a subsequent operation, i.e., after incorporation of the precursor monomer into the strand, a ligand having complementary chemical group, e.g. an alkyne or azide can be attached to the precursor monomer by coupling the alkyne and the azide together.

In some embodiments, a ligand can be conjugated to nucleobases, sugar moieties, or internucleosidic linkages of nucleic acid molecules. Conjugation to purine nucleobases or derivatives thereof can occur at any position including, endocyclic and exocyclic atoms. In some embodiments, the 2-, 6-, 7-, or 8-positions of a purine nucleobase are attached to a conjugate moiety. Conjugation to pyrimidine nucleobases or derivatives thereof can also occur at any position. In some embodiments, the 2-, 5-, and 6-positions of a pyrimidine nucleobase can be substituted with a conjugate moiety. Conjugation to sugar moieties of nucleosides can occur at any carbon atom. Example carbon atoms of a sugar moiety that can 5 be attached to a conjugate moiety include the 2', 3', and 5' carbon atoms. The 1' position can also be attached to a conjugate moiety, such as in an abasic residue. Internucleosidic linkages can also bear conjugate moieties. For phosphorus-containing linkages (e.g., phosphodiester, phosphorothioate, phosphorodithioate, phosphoroamidate, and the like), the conjugate moiety can be attached directly to the phosphorus atom or to an O, N, or S atom bound to the phosphorus atom. For amine- or amide-containing internucleosidic linkages (e.g., PNA), the conjugate moiety can be attached to the nitrogen atom of the amine or amide or to an adjacent carbon atom.

GalNAc Ligands and Linkers

In some embodiment, an siRNA targeting an HAO1 gene is conjugated to a carbohydrate e.g. monosaccharide (such as GalNAc), disaccharide, trisaccharide, tetrasaccharide, polysaccharide. In some embodiments, the siRNA is conjugated to N-acetylgalactosamine (GalNAc) ligand. The enhances efficient delivery to hepatocytes following subcutaneous administration. Methods of conjugation of carbohydrates. e.g., N-acetylgalactosamine, to, e.g., an siRNA are well known to one of skill in the art. Examples can be found in U.S. Pat. No. 8,106,022 and WO2014/025805.

In some embodiments, an siRNA targeting an HAO1 gene is conjugated to a ligand, e.g., to GalNac, via a linker. For example, the ligand can be one or more GalNAc (N-acetylglucosamine) derivatives attached through a bivalent or trivalent branched linker.

In one embodiment, the dsRNA of the invention is conjugated to a bivalent and trivalent branched linkers include the structures shown in any of formula (IV)-(VII):

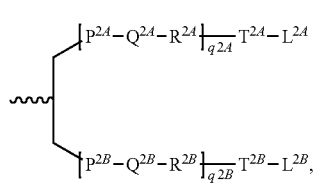

Formula (IV)

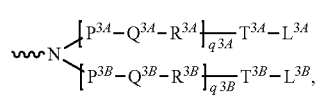

Formula (V)

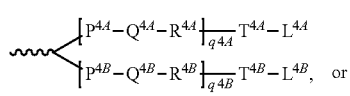

Formula (VI)

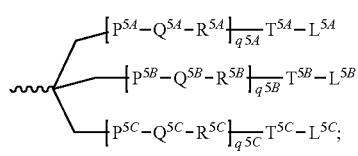

Formula (VII)

wherein:

$q^{2A}$, $q^{2B}$, $q^{3A}$, $q^{3B}$, $q^{4A}$, $q^{4B}$, $q^{5A}$, $q^{5B}$, and $q^{5C}$ represent independently for each occurrence 0-20 and wherein the repeating unit can be the same or different;

$P^{2A}$, $P^{2B}$, $P^{3A}$, $P^{3B}$, $P^{4A}$, $P^{4B}$, $P^{5A}$, $P^{5B}$, $P^{5C}$, $T^{2A}$, $T^{2B}$, $T^{3A}$, $T^{3B}$, $T^{4A}$, $T^{4B}$, $T^{4A}$, $T^{5B}$, $T^{5C}$ are each independently for each occurrence absent, CO, NH, O, S, OC(O), NHC(O), $CH_2$, $CH_2NH$ or $CH_2O$;

$Q^{2A}$, $Q^{2B}$, $Q^{3A}$, $Q^{3B}$, $Q^{4A}$, $Q^{4B}$, $Q^{5A}$, $Q^{5B}$, $Q^{5C}$ are independently for each occurrence absent, alkylene, substituted alkylene wherein one or more methylenes can be interrupted or terminated by one or more of O, S, S(O), $SO_2$, $N(R^N)$, C(R')=C(R''), C≡C or C(O);

$R^{2A}$, $R^{2B}$, $R^{3A}$, $R^{3B}$, $R^{4A}$, $R^{4B}$, $R^{5A}$, $R^{5B}$, $R^{5C}$ are each independently for each occurrence absent, NH, O, S, $CH_2$, C(O)O, C(O)NH, $NHCH(R^a)C(O)$, —C(O)—$CH(R^a)$—NH—, CO, CH=N—O,

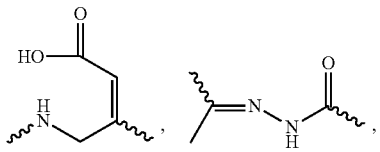

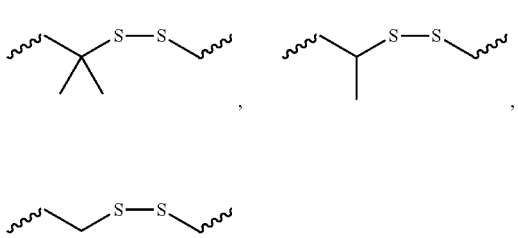

or heterocyclyl;

$L^{2A}$, $L^{2B}$, $L^{3A}$, $L^{3B}$, $L^{4A}$, $L^{4B}$, $L^{5A}$, $L^{5B}$, and $L^{5C}$ represent the ligand; i.e. each independently for each occurrence a monosaccharide (such as GalNAc), disaccharide, trisaccharide, tetrasaccharide, oligosaccharide, or polysaccharide; and $R^a$ is H or amino acid side chain.

Trivalent conjugating GalNAc derivatives are particularly useful for use with RNAi agents for inhibiting the expression of a target gene, such as those of formula (VII):

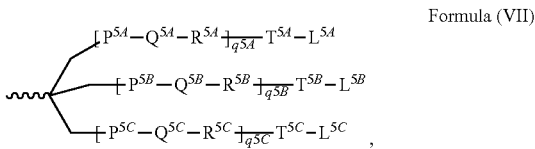

Formula (VII)

wherein $L^{5A}$, $L^{5B}$ and $L^{5C}$ represent a monosaccharide, such as GalNAc derivative.

Examples of suitable bivalent and trivalent branched linker groups conjugating GalNAc derivatives include, but are not limited to, the following compounds:

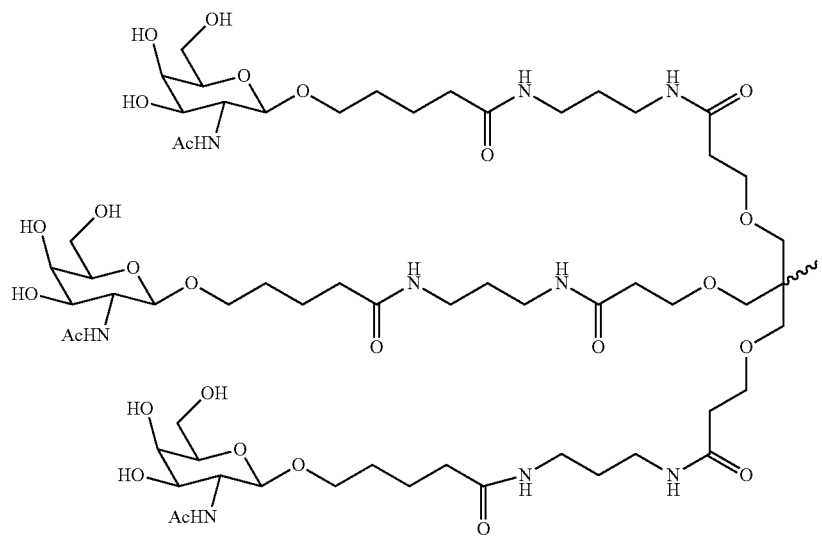
,
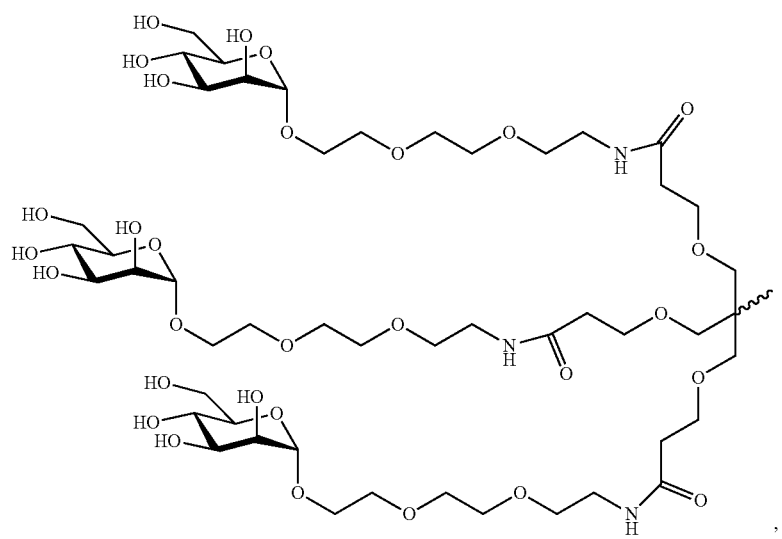
,
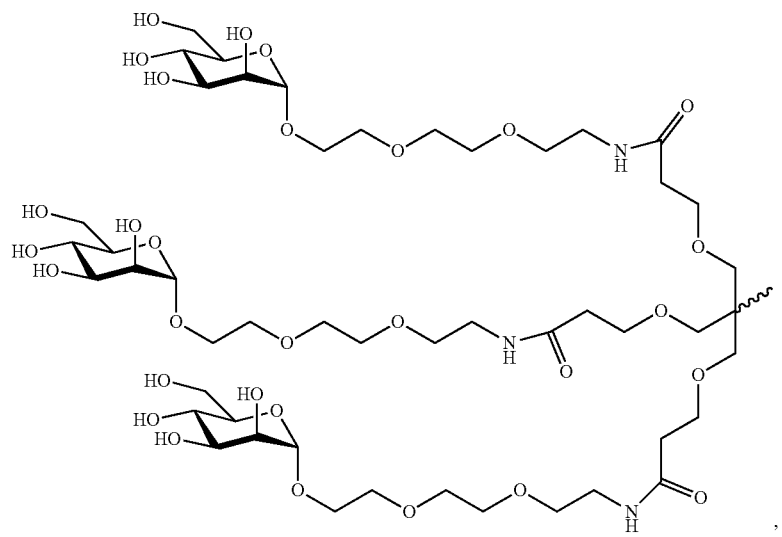
,

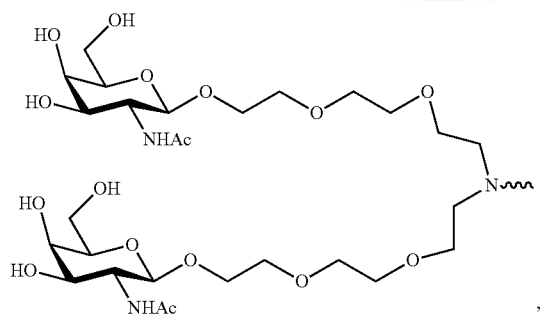
,
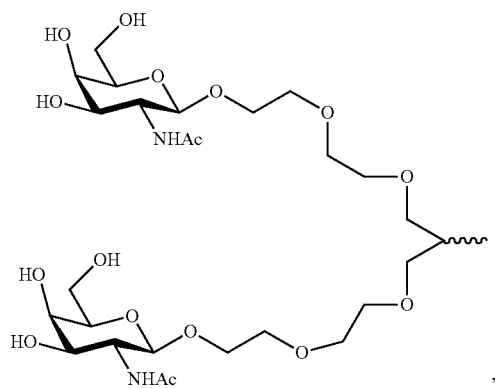
,
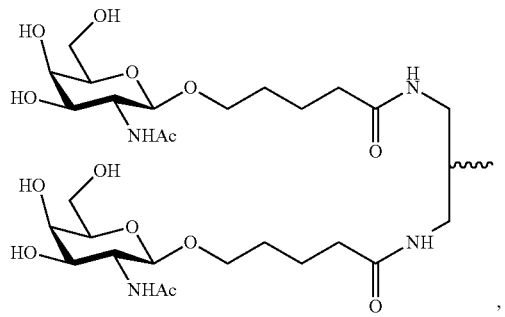
,
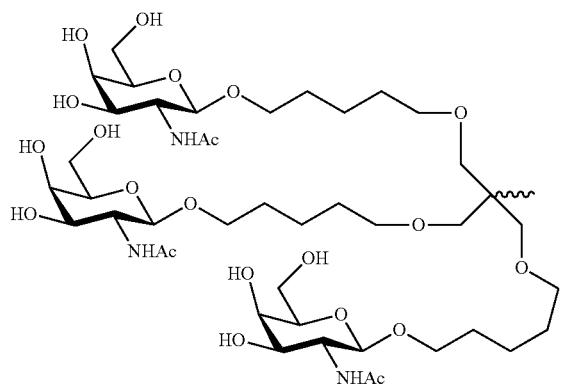

-continued
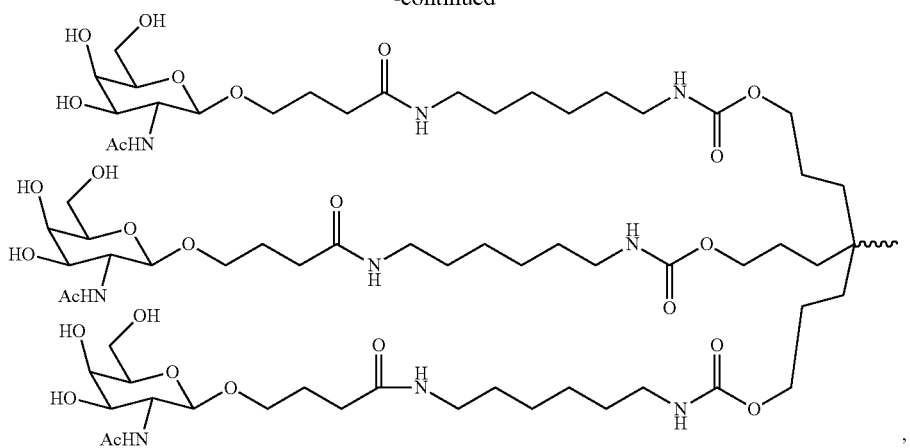
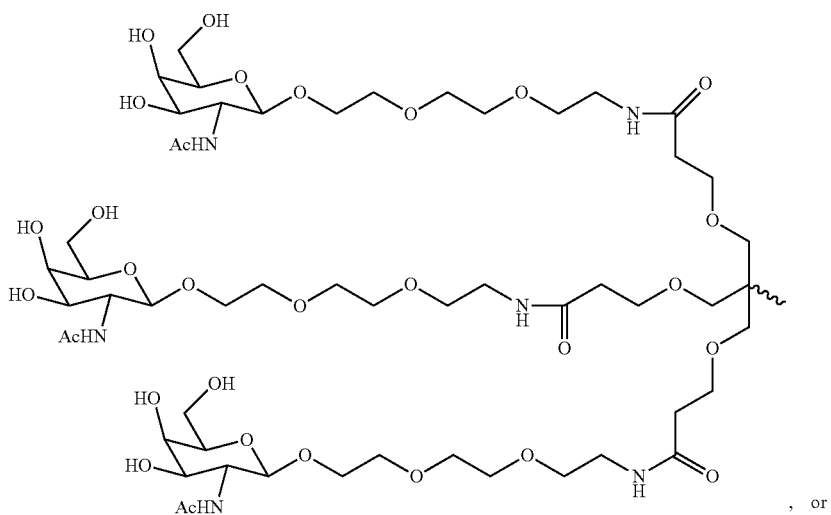
, or
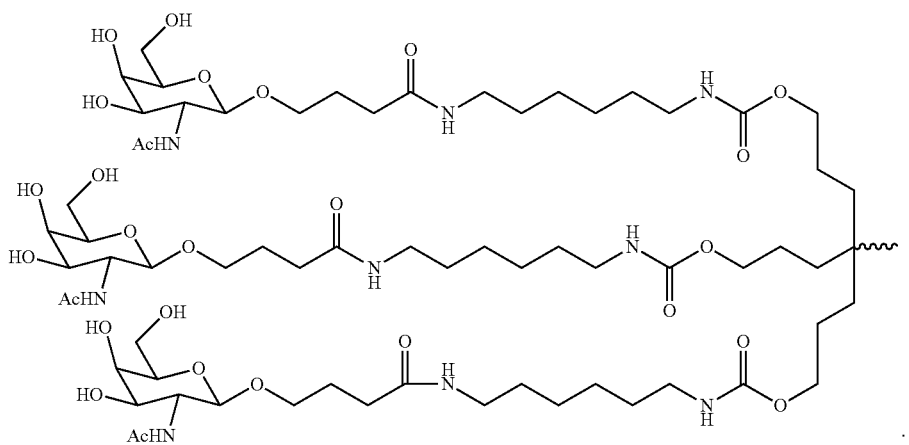

Additional Ligands
In some embodiments the ligand is selected from one of the following:
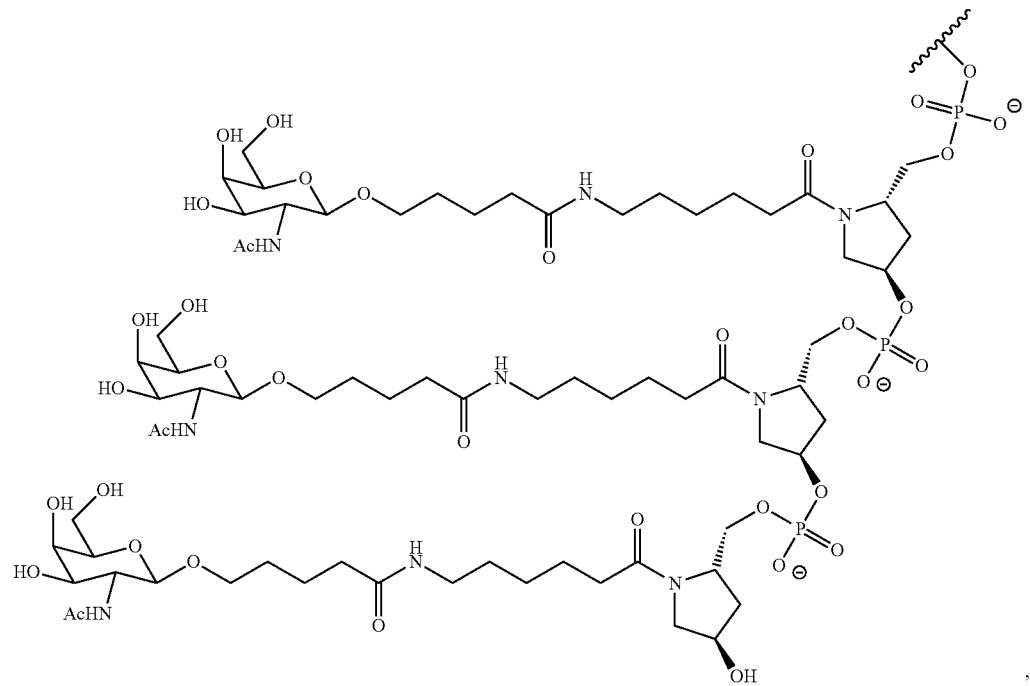
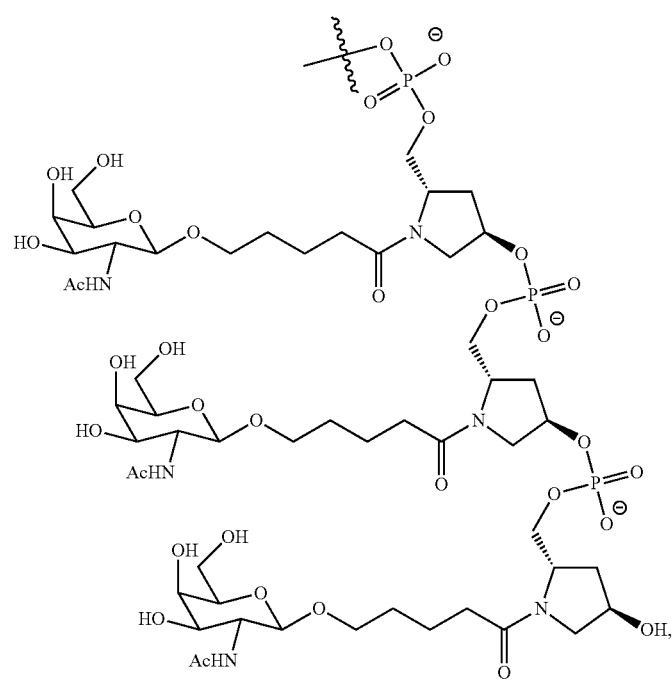

-continued
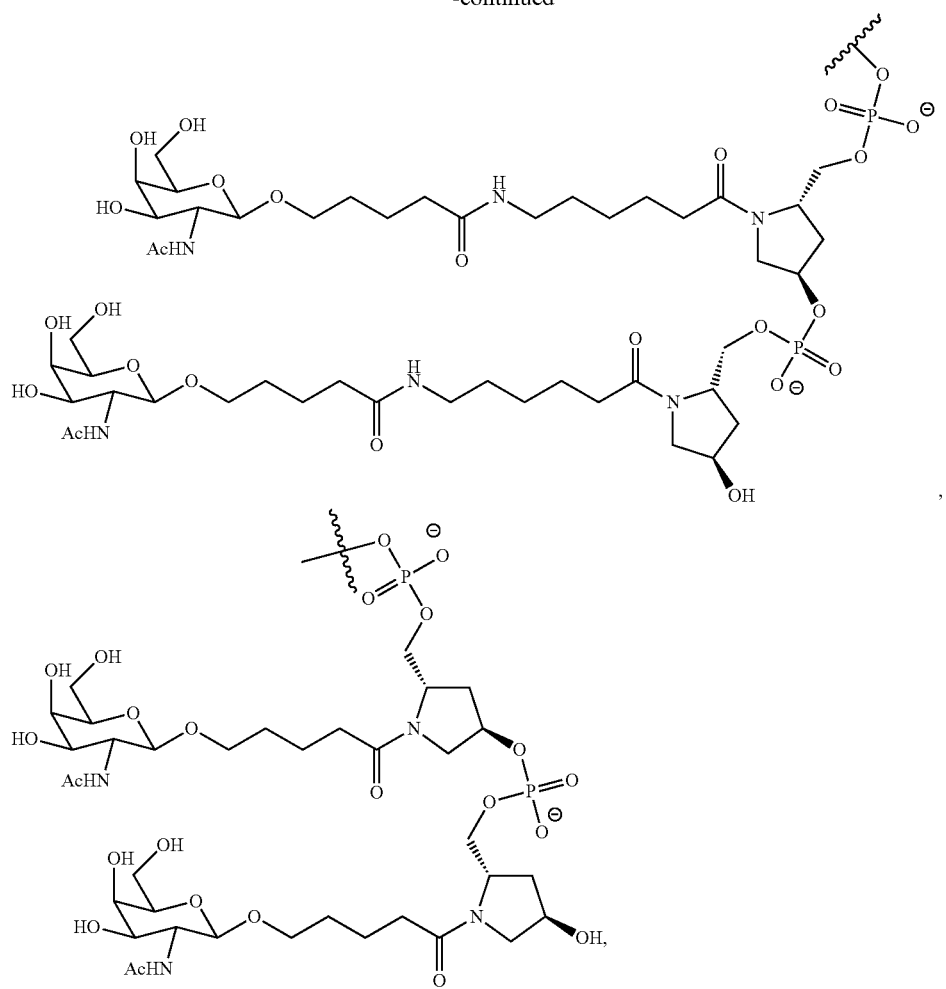
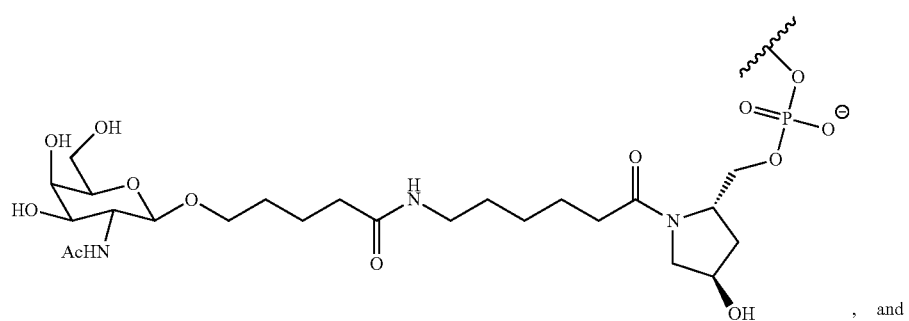
, and
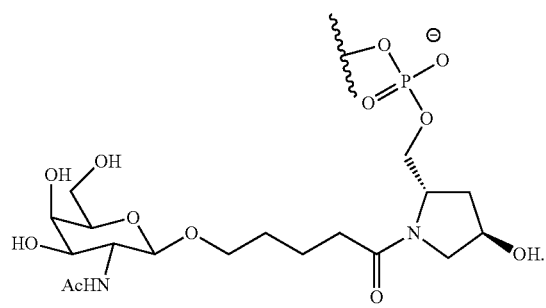

III. Delivery of an IRNA of the Invention

The delivery of an iRNA agent of the invention to a cell e.g., a cell within a subject, such as a human subject (e.g., a subject in need thereof, such as a subject having a HAO1 associated disorder) can be achieved in a number of different ways. For example, delivery may be performed by contacting a cell with an iRNA of the invention either in vitro or in vivo. In vivo delivery may also be performed directly by administering a composition comprising an iRNA, e.g., a dsRNA, to a subject. Alternatively, in viv delivery may be performed indirectly by administering one or more vectors that encode and direct the expression of the iRNA. These alternatives are discussed further below.

In general, any method of delivering a nucleic acid molecule (in vitro or in vivo) can be adapted for use with an iRNA of the invention (see e.g., Akhtar S. and Julian R L. (1992) *Trends Cell. Biol.* 2(5): 139-144 and WO94/02595, which are incorporated herein by reference in their entireties). For in vivo delivery, factors to consider in order to deliver an iRNA molecule include, for example, biological stability of the delivered molecule, prevention of non-specific effects, and accumulation of the delivered molecule in the target tissue. The non-specific effects of an iRNA can be minimized by local administration, for example, by direct injection or implantation into a tissue or topically administering the preparation. Local administration to a treatment site maximizes local concentration of the agent, limits the exposure of the agent to systemic tissues that can otherwise be harmed by the agent or that can degrade the agent, and permits a lower total dose of the iRNA molecule to be administered. Several studies have shown successful knockdown of gene products when an iRNA is administered locally. For example, intraocular delivery of a VEGF dsRNA by intravitreal injection in cynomolgus monkeys (Tolentino, M J., et al (2004) *Retina* 24:132-138) and subretinal injections in mice (Reich, S J., et al (2003) *Mol. Vis.* 9:210-216) were both shown to prevent neovascularization in an experimental model of age-related macular degeneration. In addition, direct intratumoral injection of a dsRNA in mice reduces tumor volume (Pille, J., et al (2005) *Mol. Ther.* 11:267-274) and can prolong survival of tumor-bearing mice (Kim, W J., et al (2006) *Mol. Ther.* 14:343-350; Li, S., et al (2007) *Mol. Ther.* 15:515-523). RNA interference has also shown success with local delivery to the CNS by direct injection (Dorn, G., et al. (2004) *Nucleic Acids* 32:e49; Tan, P H., et al (2005) *Gene Ther.* 12:59-66; Makimura, H., et al (2002) *BMC Neurosci.* 3:18; Shishkina, G T., et al (2004) *Neuroscience* 129:521-528; Thakker, E R., et al (2004) *Proc. Natl. Acad. Sci. U.S.A.* 101:17270-17275; Akaneya, Y., et al (2005) *J. Neurophysiol.* 93:594-602) and to the lungs by intranasal administration (Howard, K A., et al (2006) *Mol. Ther.* 14:476-484; Zhang, X., et al (2004) *J. Biol. Chem.* 279:10677-10684; Bitko, V., et al (2005) *Nat. Med.* 11:50-55). For administering an iRNA systemically for the treatment of a disease, the RNA can be modified or alternatively delivered using a drug delivery system; both methods act to prevent the rapid degradation of the dsRNA by endo- and exo-nucleases in vivo. Modification of the RNA or the pharmaceutical carrier can also permit targeting of the iRNA composition to the target tissue and avoid undesirable off-target effects. iRNA molecules can be modified by chemical conjugation to lipophilic groups such as cholesterol to enhance cellular uptake and prevent degradation. For example, an iRNA directed against ApoB conjugated to a lipophilic cholesterol moiety was injected systemically into mice and resulted in knockdown of apoB mRNA in both the liver and jejunum (Soutschek, J., et al (2004) *Nature* 432:173-178). Conjugation of an iRNA to an aptamer has been shown to inhibit tumor growth and mediate tumor regression in a mouse model of prostate cancer (McNamara, J O., et at (2006) *Nat. Biotechnol.* 24:1005-1015). In an alternative embodiment, the iRNA can be delivered using drug delivery systems such as a nanoparticle, a dendrimer, a polymer, liposomes, or a cationic delivery system. Positively charged cationic delivery systems facilitate binding of an iRNA molecule (negatively charged) and also enhance interactions at the negatively charged cell membrane to permit efficient uptake of an iRNA by the cell. Cationic lipids, dendrimers, or polymers can either be bound to an iRNA, or induced to form a vesicle or micelle (see e.g., Kim S H., et al (2008) *Journal of Controlled Release* 129(2): 107-116) that encases an iRNA. The formation of vesicles or micelles further prevents degradation of the iRNA when administered systemically. Methods for making and administering cationic-iRNA complexes are well within the abilities of one skilled in the art (see e.g., Sorensen, D R., et al (2003). *J. Mol. Biol* 327: 761-766; Verma, U N., et al (2003) *Clin. Cancer Res.* 9:1291-1300; Arnold, A S et al (2007) *J. Hypertens.* 25:197-205, which are incorporated herein by reference in their entirety). Some non-limiting examples of drug delivery systems useful for systemic delivery of iRNAs include DOTAP (Sorensen, D R., et al (2003), supra; Verma, U N., et al (2003), supra), Oligofectamine, "solid nucleic acid lipid particles" (Zimmermann, T S., et al (2006) *Nature* 441:111-114), cardiolipin (Chien, P Y., et al (2005) *Cancer Gene Ther.* 12:321-328; Pal, A., et al (2005) *Int J. Oncol.* 26:1087-1091), polyethyleneimine (Bonnet M E., et al (2008) *Pharm. Res.* August 16 Epub ahead of print; Aigner, A. (2006) J. *Biomed. Biolechnol.* 71659), Arg-Gly-Asp (RGD) peptides (Liu, S. (2006) *Mol. Pharm.* 3:472-487), and polyamidoamines (Tomalia, D A., et al (2007) *Biochem. Soc. Trans.* 35:61-67; Yoo, H., et al (1999) *Pharm. Res.* 16:1799-1804). In some embodiments, an iRNA forms a complex with cyclodextrin for systemic administration. Methods for administration and pharmaceutical compositions of iRNAs and cyclodextrins can be found in U.S. Pat. No. 7,427,605, which is herein incorporated by reference in its entirety.

Vector Encoded iRNAs of the Invention iRNA targeting the HAO1 gene can be expressed from transcription units inserted into DNA or RNA vectors (see, e.g., Couture, A, et al., *TIG.* (1996), 12:5-10; Skillern, A., et al., International PCT Publication No. WO 00/22113, Conrad, International PCT Publication No. WO 00/22114, and Conrad, U.S. Pat. No. 6,054,299). Expression can be transient (on the order of hours to weeks) or sustained (weeks to months or longer), depending upon the specific construct used and the target tissue or cell type. These transgenes can be introduced as a linear construct, a circular plasmid, or a viral vector, which can be an integrating or non-integrating vector. The transgene can also be constructed to permit it to be inherited as an extrachromosomal plasmid (Gassmann, et al., *Proc. Natl. Acad. Sci. USA* (1995) 92:1292).

The individual strand or strands of an iRNA can be transcribed from a promoter on an expression vector. Where two separate strands are to be expressed to generate, for example, a dsRNA, two separate expression vectors can be co-introduced (e.g., by transfection or infection) into a target cell. Alternatively each individual strand of a dsRNA can be transcribed by promoters both of which are located on the same expression plasmid. In one embodiment, a dsRNA is expressed as inverted repeat polynucleotides joined by a linker polynucleotide sequence such that the dsRNA has a stem and loop structure.

iRNA expression vectors are generally DNA plasmids or viral vectors. Expression vectors compatible with eukaryotic cells, preferably those compatible with vertebrate cells, can be used to produce recombinant constructs for the expression of an iRNA as described herein. Eukaryotic cell expression vectors are well known in the art and are available from a number of commercial sources. Typically, such vectors are provided containing convenient restriction sites for insertion of the desired nucleic acid segment. Delivery of iRNA expressing vectors can be systemic, such as by intravenous or intramuscular administration, by administration to target cells ex-planted from the patient followed by reintroduction into the patient, or by any other means that allows for introduction into a desired target cell.

iRNA expression plasmids can be transfected into target cells as a complex with cationic lipid carriers (e.g., Oligofectamine) or non-cationic lipid-based carriers (e.g., Transit-TKO™). Multiple lipid transfections for iRNA-mediated knockdowns targeting different regions of a target RNA over a period of a week or more are also contemplated by the invention. Successful introduction of vectors into host cells can be monitored using various known methods. For example, transient transfection can be signaled with a reporter, such as a fluorescent marker, such as Green Fluorescent Protein (GFP). Stable transfection of cells ex vivo can be ensured using markers that provide the transfected cell with resistance to specific environmental factors (e.g., antibiotics and drugs), such as hygromycin B resistance.

Viral vector systems which can be utilized with the methods and compositions described herein include, but are not limited to, (a) adenovirus vectors; (b) retrovirus vectors, including but not limited to lentiviral vectors, moloney murine leukemia virus, etc.; (c) adeno-associated virus vectors; (d) herpes simplex virus vectors; (e) SV 40 vectors; (f) polyoma virus vectors; (g) papilloma virus vectors; (h) picornavirus vectors; (i) pox virus vectors such as an orthopox, e.g., vaccinia virus vectors or avipox, e.g. canary pox or fowl pox; and (j) a helper-dependent or gutless adenovirus. Replication-defective viruses can also be advantageous. Different vectors will or will not become incorporated into the cells' genome. The constructs can include viral sequences for transfection, if desired. Alternatively, the construct can be incorporated into vectors capable of episomal replication, e.g. EPV and EBV vectors. Constructs for the recombinant expression of an iRNA will generally require regulatory elements, e.g., promoters, enhancers, etc., to ensure the expression of the iRNA in target cells. Other aspects to consider for vectors and constructs are further described below.

Vectors useful for the delivery of an iRNA will include regulatory elements (promoter, enhancer, etc.) sufficient for expression of the iRNA in the desired target cell or tissue. The regulatory elements can be chosen to provide either constitutive or regulated/inducible expression.

Expression of the iRNA can be precisely regulated, for example, by using an inducible regulatory sequence that is sensitive to certain physiological regulators, e.g., circulating glucose levels, or hormones (Docherty et al., 1994, *FASEB J.* 8:20-24). Such inducible expression systems, suitable for the control of dsRNA expression in cells or in mammals include, for example, regulation by ecdysone, by estrogen, progesterone, tetracycline, chemical inducers of dimerization, and isopropyl-beta-D1-thiogalactopyranoside (IPTG). A person skilled in the art would be able to choose the appropriate regulatory/promoter sequence based on the intended use of the iRNA transgene.

Viral vectors that contain nucleic acid sequences encoding an iRNA can be used. For example, a retroviral vector can be used (see Miller et al., *Meth. Enzymol.* 217:581-599 (1993)). These retroviral vectors contain the components necessary for the correct packaging of the viral genome and integration into the host cell DNA. The nucleic acid sequences encoding an iRNA are cloned into one or more vectors, which facilitate delivery of the nucleic acid into a patient. More detail about retroviral vectors can be found, for example, in Boesen et al., *Biotherapy* 6:291-302 (1994), which describes the use of a retroviral vector to deliver the mdr1 gene to hematopoietic stem cells in order to make the stem cells more resistant to chemotherapy. Other references illustrating the use of retroviral vectors in gene therapy are: Clowes et al., *J. Clin. Invest.* 93:644-651 (1994): Kiem et al., *Blood* 83:1467-1473 (1994); Salmons and Gunzberg. *Human Gene Therapy* 4:129-141 (1993); and Grossman and Wilson, *Curr. Opin. in Genetics and Devel.* 3:110-114 (1993). Lentiviral vectors contemplated for use include, for example, the HIV based vectors described in U.S. Pat. Nos. 6,143,520; 5,665,557; and 5,981,276, which are herein incorporated by reference.

Adenoviruses are also contemplated for use in delivery of iRNAs of the invention. Adenoviruses are especially attractive vehicles, e.g., for delivering genes to respiratory epithelia. Adenoviruses naturally infect respiratory epithelia where they cause a mild disease. Other targets for adenovirus-based delivery systems are liver, the central nervous system, endothelial cells, and muscle. Adenoviruses have the advantage of being capable of infecting non-dividing cells. Kozarsky and Wilson, *Current Opinion in Genetics and Development* 3:499-503 (1993) present a review of adenovirus-based gene therapy. Bout et al., *Human Gene Therapy* 5:3-10 (1994) demonstrated the use of adenovirus vectors to transfer genes to the respiratory epithelia of rhesus monkeys. Other instances of the use of adenoviruses in gene therapy can be found in Rosenfeld et al., *Science* 252:431-434 (1991); Rosenfeld et al., *Cell* 68:143-155 (1992); Mastrangeli et al., *J. Clin. Invest.* 91:225-234 (1993); PCT Publication WO94/12649: and Wang, et al., *Gene Therapy* 2:775-783 (1995). A suitable AV vector for expressing an iRNA featured in the invention, a method for constructing the recombinant AV vector, and a method for delivering the vector into target cells, are described in Xia H et al. (2002), *Nat. Biotech.* 20: 1006-1010.

Adeno-associated virus (AAV) vectors may also be used to delivery an iRNA of the invention (Walsh et al., Proc. Soc. Exp. Biol. Med. 204:289-300 (1993); U.S. Pat. No. 5,436,146). In one embodiment, the iRNA can be expressed as two separate, complementary single-stranded RNA molecules from a recombinant AAV vector having, for example, either the U6 or H1 RNA promoters, or the cytomegalovirus (CMV) promoter. Suitable AAV vectors for expressing the dsRNA featured in the invention, methods for constructing the recombinant AV vector, and methods for delivering the vectors into target cells are described in Samulski R et al. (1987), *J. Virol.* 61: 3096-3101; Fisher K J et al. (1996), *J. Virol,* 70: 520-532; Samulski R et al. (1989), *J. Virol.* 63: 3822-3826; U.S. Pat. Nos. 5,252,479; 5,139,941; International Patent Application No. WO 94/13788; and International Patent Application No. WO 93/24641, the entire disclosures of which are herein incorporated by reference.

Another viral vector suitable for delivery of an iRNA of the invention is a pox virus such as a vaccinia virus, for example an attenuated vaccinia such as Modified Virus Ankara (MVA) or NYVAC, an avipox such as fowl pox or canary pox.

The tropism of viral vectors can be modified by pseudotyping the vectors with envelope proteins or other surface antigens from other viruses, or by substituting different viral capsid proteins, as appropriate. For example, lentiviral vectors can be pseudotyped with surface proteins from vesicular stomatitis virus (VSV), rabies, Ebola, Mokola, and the like. AAV vectors can be made to target different cells by engineering the vectors to express different capsid protein serotypes; see, e.g., Rabinowitz J E et al. (2002), *J Virol* 76:791-801, the entire disclosure of which is herein incorporated by reference.

The pharmaceutical preparation of a vector can include the vector in an acceptable diluent, or can include a slow release matrix in which the gene delivery vehicle is imbedded.

Alternatively, where the complete gene delivery vector can be produced intact from recombinant cells, e.g., retroviral vectors, the pharmaceutical preparation can include one or more cells which produce the gene delivery system.

IV. Pharmaceutical Compositions of the Invention

The present invention also includes pharmaceutical compositions and formulations which include the iRNAs of the invention. In one embodiment, provided herein are pharmaceutical compositions containing an iRNA, as described herein, and a pharmaceutically acceptable carrier. The pharmaceutical compositions containing the iRNA are useful for treating a HAO1 associated disease or disorder. Such pharmaceutical compositions are formulated based on the mode of delivery.

The pharmaceutical compositions comprising RNAi agents of the invention may be, for example, solutions with or without a buffer, or compositions containing pharmaceutically acceptable carriers. Such compositions include, for example, aqueous or crystalline compositions, liposomal formulations, micellar formulations, emulsions, and gene therapy vectors.

In the methods of the invention, the RNAi agent may be administered in a solution. A free RNAi agent may be administered in an unbuffered solution, e.g., in saline or in water. Alternatively, the free siRNA may also be administered in a suitable buffer solution. The buffer solution may comprise acetate, citrate, prolamine, carbonate, or phosphate, or any combination thereof. In one embodiment, the buffer solution is phosphate buffered saline (PBS). The pH and osmolarity of the buffer solution containing the RNAi agent can be adjusted such that it is suitable for administering to a subject.

In some embodiments, the buffer solution further comprises an agent for controlling the osmolarity of the solution, such that the osmolarity is kept at a desired value, e.g., at the physiologic values of the human plasma. Solutes which can be added to the buffer solution to control the osmolarity include, but are not limited to, proteins, peptides, amino acids, non-metabolized polymers, vitamins, ions, sugars, metabolites, organic acids, lipids, or salts. In some embodiments, the agent for controlling the osmolarity of the solution is a salt. In certain embodiments, the agent for controlling the osmolarity of the solution is sodium chloride or potassium chloride.

The pharmaceutical compositions of the invention may be administered in dosages sufficient to inhibit expression of a HAO1 gene.

Dosages

In general, a suitable dose of an iRNA of the invention will be in the range of about 0.001 to about 200.0 milligrams per kilogram body weight of the recipient per day, generally in the range of about 0.1 to 10 or 1 to 50 mg per kilogram body weight per day. For example, the dsRNA can be administered at about 0.01 mg/kg, about 0.05 mg/kg, about 0.5 mg/kg, about 1 mg/kg, about 1.5 mg/kg, about 2 mg/kg, about 3 mg/kg, about 4 mg/kg, about 5 mg/kg, about 6 mg/kg, about 7 mg/kg, about 8 mg/kg, about 9 mg/kg about 10 mg/kg, about 20 mg/kg, about 30 mg/kg, about 40 mg/kg, or about 50 mg/kg per single dose.

In another embodiment, the RNAi agent, e.g., dsRNA, is administered at a dose of about 0.1 to about 50 mg/kg, about 0.25 to about 50 mg/kg, about 0.5 to about 50 mg/kg, about 0.75 to about 50 mg/kg, about 1 to about 50 mg/mg, about 1.5 to about 50 mg/kb, about 2 to about 50 mg/kg, about 2.5 to about 50 mg/kg, about 3 to about 50 mg/kg, about 3.5 to about 50 mg/kg, about 4 to about 50 mg/kg, about 4.5 to about 50 mg/kg, about 5 to about 50 mg/kg, about 7.5 to about 50 mg/kg, about 10 to about 50 mg/kg, about 15 to about 50 mg/kg, about 20 to about 50 mg/kg, about 20 to about 50 mg/kg, about 25 to about 50 mg/kg, about 25 to about 50 mg/kg, about 30 to about 50 mg/kg, about 35 to about 50 mg/kg, about 40 to about 50 mg/kg, about 45 to about 50 mg/kg, about 0.1 to about 45 mg/kg, about 0.25 to about 45 mg/kg, about 0.5 to about 45 mg/kg, about 0.75 to about 45 mg/kg, about 1 to about 45 mg/mg, about 1.5 to about 45 mg/kb, about 2 to about 45 mg/kg, about 2.5 to about 45 mg/kg, about 3 to about 45 mg/kg, about 3.5 to about 45 mg/kg, about 4 to about 45 mg/kg, about 4.5 to about 45 mg/kg, about 5 to about 45 mg/kg, about 7.5 to about 45 mg/kg, about 10 to about 45 mg/kg, about 15 to about 45 mg/kg, about 20 to about 45 mg/kg, about 20 to about 45 mg/kg, about 25 to about 45 mg/kg, about 25 to about 45 mg/kg, about 30 to about 45 mg/kg, about 35 to about 45 mg/kg, about 40 to about 45 mg/kg, about 0.1 to about 40 mg/kg, about 0.25 to about 40 mg/kg, about 0.5 to about 40 mg/kg, about 0.75 to about 40 mg/kg, about 1 to about 40 mg/mg, about 1.5 to about 40 mg/kb, about 2 to about 40 mg/kg, about 2.5 to about 40 mg/kg, about 3 to about 40 mg/kg, about 3.5 to about 40 mg/kg, about 4 to about 40 mg/kg, about 4.5 to about 40 mg/kg, about 5 to about 40 mg/kg, about 7.5 to about 40 mg/kg, about 10 to about 40 mg/kg, about 15 to about 40 mg/kg, about 20 to about 40 mg/kg, about 20 to about 40 mg/kg, about 25 to about 40 mg/kg, about 25 to about 40 mg/kg, about 30 to about 40 mg/kg, about 35 to about 40 mg/kg, about 0.1 to about 30 mg/kg, about 0.25 to about 30 mg/kg, about 0.5 to about 30 mg/kg, about 0.75 to about 30 mg/kg, about 1 to about 30 mg/mg, about 1.5 to about 30 mg/kb, about 2 to about 30 mg/kg, about 2.5 to about 30 mg/kg, about 3 to about 30 mg/kg, about 3.5 to about 30 mg/kg, about 4 to about 30 mg/kg, about 4.5 to about 30 mg/kg, about 5 to about 30 mg/kg, about 7.5 to about 30 mg/kg, about 10 to about 30 mg/kg, about 15 to about 30 mg/kg, about 20 to about 30 mg/kg, about 20 to about 30 mg/kg, about 25 to about 30 mg/kg, about 0.1 to about 20 mg/kg, about 0.25 to about 20 mg/kg, about 0.5 to about 20 mg/kg, about 0.75 to about 20 mg/kg, about 1 to about 20 mg/mg, about 1.5 to about 20 mg/kb, about 2 to about 20 mg/kg, about 2.5 to about 20 mg/kg, about 3 to about 20 mg/kg, about 3.5 to about 20 mg/kg, about 4 to about 20 mg/kg, about 4.5 to about 20 mg/kg, about 5 to about 20 mg/kg, about 7.5 to about 20 mg/kg, about 10 to about 20 mg/kg, or about 15 to about 20 mg/kg. Values and ranges intermediate to the recited values are also intended to be part of this invention.

For example, the RNAi agent, e.g., dsRNA, may be administered at a dose of about 0.01, 0.02, 0.03, 0.04, 0.05, 0.06, 0.07, 0.08, 0.09, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.4, 2.5, 2.6, 2.7, 2.8, 2.9, 3.0, 3.1, 3.2, 3.3, 3.4, 3.5, 3.6, 3.7, 3.8, 3.9, 4.0, 4.1, 4.2, 4.3, 4.4, 4.5, 4.6, 4.7, 4.8, 4.9, 5.0, 5.1, 5.2, 5.3, 5.4, 5.5, 5.6, 5.7, 5.8, 5.9, 6.0, 6.1, 6.2, 6.3, 6.4, 6.5, 6.6, 6.7, 6.8, 6.9, 7.0, 7.1, 7.2, 7.3, 7.4, 7.5, 7.6, 7.7, 7.8, 7.9, 8.0, 8.1, 8.2, 8.3, 8.4, 8.5, 8.6, 8.7, 8.8, 8.9, 9.0, 9.1, 9.2, 9.3, 9.4, 9.5, 9.6, 9.7, 9.8, 9.9, 10, 10.5, 11, 11.5, 12, 12.5, 13, 13.5, 14, 14.5, 15, 15.5, 16, 16.5, 17, 17.5, 18, 18.5, 19, 19.5, 20, 20.5, 21, 21.5, 22, 22.5, 23, 23.5, 24, 24.5, 25, 25.5, 26, 26.5, 27, 27.5, 28, 28.5, 29, 29.5, 30, 31, 32, 33, 34, 34, 35, 36, 37, 38, 39, 40, 41, 42, 43, 44, 45, 46, 47, 48, 49, or about 50 mg/kg. Values and ranges intermediate to the recited values are also intended to be part of this invention.

In certain embodiments of the invention, for example, when a double-stranded RNAi agent includes modifications (e.g., one or more motifs of three identical modifications on three consecutive nucleotides, including one such motif at or near the cleavage site of the agent), six phosphorothioate linkages, and a ligand, such an agent is administered at a dose of about 0.01 to about 0.5 mg/kg, about 0.01 to about 0.4 mg/kg, about 0.01 to about 0.3 mg/kg, about 0.01 to about 0.2 mg/kg, about 0.01 to about 0.1 mg/kg, about 0.01 mg/kg to about 0.09 mg/kg, about 0.01 mg/kg to about 0.08 mg/kg, about 0.01 mg/kg to about 0.07 mg/kg, about 0.01 mg/kg to about 0.06 mg/kg, about 0.01 mg/kg to about 0.05 mg/kg, about 0.02 to about 0.5 mg/kg, about 0.02 to about 0.4 mg/kg, about 0.02 to about 0.3 mg/kg, about 0.02 to about 0.2 mg/kg, about 0.02 to about 0.1 mg/kg, about 0.02 mg/kg to about 0.09 mg/kg, about 0.02 mg/kg to about 0.08 mg/kg, about 0.02 mg/kg to about 0.07 mg/kg, about 0.02 mg/kg to about 0.06 mg/kg, about 0.02 mg/kg to about 0.05 mg/kg, about 0.03 to about 0.5 mg/kg, about 0.03 to about 0.4 mg/kg, about 0.03 to about 0.3 mg/kg, about 0.03 to about 0.2 mg/kg, about 0.03 to about 0.1 mg/kg, about 0.03 mg/kg to about 0.09 mg/kg, about 0.03 mg/kg to about 0.08 mg/kg, about 0.03 mg/kg to about 0.07 mg/kg, about 0.03 mg/kg to about 0.06 mg/kg, about 0.03 mg/kg to about 0.05 mg/kg, about 0.04 to about 0.5 mg/kg, about 0.04 to about 0.4 mg/kg, about 0.04 to about 0.3 mg/kg, about 0.04 to about 0.2 mg/kg, about 0.04 to about 0.1 mg/kg, about 0.04 mg/kg to about 0.09 mg/kg, about 0.04 mg/kg to about 0.08 mg/kg, about 0.04 mg/kg to about 0.07 mg/kg, about 0.04 mg/kg to about 0.06 mg/kg, about 0.05 to about 0.5 mg/kg, about 0.05 to about 0.4 mg/kg, about 0.05 to about 0.3 mg/kg, about 0.05 to about 0.2 mg/kg, about 0.05 to about 0.1 mg/kg, about 0.05 mg/kg to about 0.09 mg/kg, about 0.05 mg/kg to about 0.08 mg/kg, or about 0.05 mg/kg to about 0.07 mg/kg. Values and ranges intermediate to the foregoing recited values are also intended to be part of this invention, e.g., the RNAi agent may be administered to the subject at a dose of about 0.015 mg/kg to about 0.45 mg/mg.

For example, the RNAi agent, e.g., RNAi agent in a pharmaceutical composition, may be administered at a dose of about 0.01 mg/kg, 0.0125 mg/kg, 0.015 mg/kg, 0.0175 mg/kg, 0.02 mg/kg, 0.0225 mg/kg, 0.025 mg/kg, 0.0275 mg/kg, 0.03 mg/kg, 0.0325 mg/kg, 0.035 mg/kg, 0.0375 mg/kg, 0.04 mg/kg, 0.0425 mg/kg, 0.045 mg/kg, 0.0475 mg/kg, 0.05 mg/kg, 0.0525 mg/kg, 0.055 mg/kg, 0.0575 mg/kg, 0.06 mg/kg, 0.0625 mg/kg, 0.065 mg/kg, 0.0675 mg/kg, 0.07 mg/kg, 0.0725 mg/kg, 0.075 mg/kg, 0.0775 mg/kg, 0.08 mg/kg, 0.0825 mg/kg, 0.085 mg/kg, 0.0875 mg/kg, 0.09 mg/kg, 0.0925 mg/kg, 0.095 mg/kg, 0.0975 mg/kg, 0.1 mg/kg, 0.125 mg/kg, 0.15 mg/kg, 0.175 mg/kg, 0.2 mg/kg, 0.225 mg/kg, 0.25 mg/kg, 0.275 mg/kg, 0.3 mg/kg, 0.325 mg/kg, 0.35 mg/kg, 0.375 mg/kg, 0.4 mg/kg, 0.425 mg/kg, 0.45 mg/kg, 0.475 mg/kg, or about 0.5 mg/kg. Values intermediate to the foregoing recited values are also intended to be part of this invention.

Treatment Regimens

The pharmaceutical composition can be administered once daily, or the iRNA can be administered as two, three, or more sub-doses at appropriate intervals throughout the day or even using continuous infusion or delivery through a controlled release formulation. In that case, the iRNA contained in each sub-dose must be correspondingly smaller in order to achieve the total daily dosage. The dosage unit can also be compounded for delivery over several days, e.g., using a conventional sustained release formulation which provides sustained release of the iRNA over a several day period. Sustained release formulations are well known in the art and are particularly useful for delivery of agents at a particular site, such as could be used with the agents of the present invention. In this embodiment, the dosage unit contains a corresponding multiple of the daily dose.

In other embodiments, a single dose of the pharmaceutical compositions can be long lasting, such that subsequent doses are administered at not more than 3, 4, or 5 day intervals, or at not more than 1, 2, 3, or 4 week intervals. In some embodiments of the invention, a single dose of the pharmaceutical compositions of the invention is administered once per week. In other embodiments of the invention, a single dose of the pharmaceutical compositions of the invention is administered bi-monthly.

The skilled artisan will appreciate that certain factors can influence the dosage and timing required to effectively treat a subject, including but not limited to the severity of the disease or disorder, previous treatments, the general health and/or age of the subject, and other diseases present. Moreover, treatment of a subject with a therapeutically effective amount of a composition can include a single treatment or a series of treatments. Estimates of effective dosages and in vivo half-lives for the individual iRNAs encompassed by the invention can be made using conventional methodologies.

Estimates of effective dosages and in rivo half-lives for the individual iRNAs encompassed by the invention can also be made on the basis of in rivo testing using an appropriate animal model. For example, advances in mouse genetics have generated a number of mouse models for the study of various human diseases, such as a disorder associated expression of HAO1. Such models can be used for in vivo testing of iRNA, as well as for determining a therapeutically effective dose. Suitable mouse models are known in the art and include, for example, the animal models described herein.

Administration Methods

The pharmaceutical compositions of the present invention can be administered in a number of ways depending upon whether local or systemic treatment is desired and upon the area to be treated. Administration can be topical (e.g., by a transdermal patch), pulmonary, e.g., by inhalation or insufflation of powders or aerosols, including by nebulizer; intratracheal, intranasal, epidermal and transdermal, oral or parenteral. Parenteral administration includes intravenous, intraarterial, subcutaneous, intraperitoneal or intramuscular injection or infusion; subdermal, e.g., via an implanted device; or intracranial, e.g., by intraparenchymal, intrathecal or intraventricular, administration The iRNA can be delivered in a manner to target a particular tissue, such as the liver.

Formulations

Pharmaceutical compositions of the present invention include, but are not limited to, solutions, emulsions, and liposome-containing formulations. These compositions can be generated from a variety of components that include, but are not limited to, preformed liquids, self-emulsifying solids and self-emulsifying semisolids.

The pharmaceutical formulations of the present invention, which can conveniently be presented in unit dosage form, can be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers or finely divided solid carriers or both, and then, if necessary, shaping the product.

The compositions of the present invention can be formulated into any of many possible dosage forms such as, but not limited to, tablets, capsules, gel capsules, liquid syrups, soft gels, suppositories, and enemas. The compositions of the present invention can also be formulated as suspensions in aqueous, non-aqueous or mixed media. Aqueous suspensions can further contain substances which increase the viscosity of the suspension including, for example, sodium carboxymethylcellulose, sorbitol and/or dextran. The suspension can also contain stabilizers.

The compositions of the present invention can be formulated for oral administration; parenteral, intraparenchymal (into the brain), intrathecal, intraventricular or intrahepatic administration, and/or topical administration.

Compositions and formulations for oral administration include powders or granules, microparticulates, nanoparticulates, suspensions or solutions in water or non-aqueous media, capsules, gel capsules, sachets, tablets or minitablets. Thickeners, flavoring agents, diluents, emulsifiers, dispersing aids or binders can be desirable. In some embodiments, oral formulations are those in which dsRNAs featured in the invention are administered in conjunction with one or more penetration enhancer surfactants and chelators. Suitable surfactants include fatty acids and/or esters or salts thereof, bile acids and/or salts thereof. Suitable bile acids/salts include chenodeoxycholic acid (CDCA) and ursodeoxychenodeoxycholic acid (UDCA), cholic acid, dehydrocholic acid, deoxycholic acid, glucholic acid, glycholic acid, glycodeoxycholic acid, taurocholic acid, taurodeoxycholic acid, sodium tauro-24,25-dihydro-fusidate and sodium glycodihydrofusidate. Suitable fatty acids include arachidonic acid, undecanoic acid, oleic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a monoglyceride, a diglyceride or a pharmaceutically acceptable salt thereof (e.g., sodium). In some embodiments, combinations of penetration enhancers are used, for example, fatty acids/salts in combination with bile acids/salts. One exemplary combination is the sodium salt of lauric acid, capric acid and UDCA. Further penetration enhancers include polyoxyethylene-9-lauryl ether, polyoxyethylene-20-cetyl ether. DsRNAs featured in the invention can be delivered orally, in granular form including sprayed dried particles, or complexed to form micro or nanoparticles. DsRNA complexing agents include poly-amino acids; polyimines; polyacrylates; poly-alkylacrylates, polyoxethanes, polyalkylcyanoacrylates; cationized gelatins, albumins, starches, acrylates, polyethyleneglycols (PEG) and starches; polyalkylcyanoacrylates; DEAE-derivatized polyimines, pollulans, celluloses and starches. Suitable complexing agents include chitosan, N-trimethylchitosan, poly-L-lysine, polyhistidine, polyornithine, polyspermines, protamine, polyvinylpyridine, polythiodiethylaminomethylethylene P(TDAE), polyaminostyrene (e.g., p-amino), poly(methylcyanoacrylate), poly (ethylcyanoacrylate), poly(butylcyanoacrylate), poly (isobutylcyanoacrylate), poly(isohexylcynaoacrylate), DEAE-methacrylate, DEAE-hexylacrylate, DEAE-acrylamide, DEAE-albumin and DEAE-dextran, polymethylacrylate, polyhexylacrylate, poly(D,L-lactic acid), poly(DL-lactic-co-glycolic acid (PLGA), alginate, and polyethyleneglycol (PEG). Oral formulations for dsRNAs and their preparation are described in detail in U.S. Pat. No. 6,887,906, US Publn. No. 20030027780, and U.S. Pat. No. 6,747,014, each of which is incorporated herein by reference.

Compositions and formulations for parenteral, intraparenchymal (into the brain), intrathecal, intraventricular or intrahepatic administration can include sterile aqueous solutions which can also contain buffers, diluents and other suitable additives such as, but not limited to, penetration enhancers, carrier compounds and other pharmaceutically acceptable carriers or excipients.

Pharmaceutical compositions and formulations for topical administration can include transdermal patches, ointments, lotions, creams, gels, drops, suppositories, sprays, liquids and powders. Conventional pharmaceutical carriers, aqueous, powder or oily bases, thickeners and the like can be necessary or desirable. Coated condoms, gloves and the like can also be useful. Suitable topical formulations include those in which the iRNAs featured in the invention are in admixture with a topical delivery agent such as lipids, liposomes, fatty acids, fatty acid esters, steroids, chelating agents and surfactants. Suitable lipids and liposomes include neutral (e.g., dioleoylphosphatidyl DOPE ethanolamine, dimyristoylphosphatidyl choline DMPC, distearolyphosphatidyl choline) negative (e.g., dimyristoylphosphatidyl glycerol DMPG) and cationic (e.g., dioleoyltetramethylaminopropyl DOTAP and dioleoylphosphatidyl ethanolamine DOTMA). iRNAs featured in the invention can be encapsulated within liposomes or can form complexes thereto, in particular to cationic liposomes. Alternatively, iRNAs can be complexed to lipids, in particular to cationic lipids. Suitable fatty acids and esters include but are not limited to arachidonic acid, oleic acid, eicosanoic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a $C_{1-20}$ alkyl ester (e.g., isopropylmyristate IPM), monoglyceride, diglyceride or pharmaceutically acceptable salt thereof). Topical formulations are described in detail in U.S. Pat. No. 6,747,014, which is incorporated herein by reference.

iRNA Formulations Comprising Membranous Molecular Assemblies

An iRNA for use in the compositions and methods of the invention can be formulated for delivery in a membranous molecular assembly, e.g., a liposome or a micelle. As used herein, the term "liposome" refers to a vesicle composed of amphiphilic lipids arranged in at least one bilayer, e.g., one bilayer or a plurality of bilayers. Liposomes include unilamellar and multilamellar vesicles that have a membrane formed from a lipophilic material and an aqueous interior. The aqueous portion contains the iRNA composition. The lipophilic material isolates the aqueous interior from an aqueous exterior, which typically does not include the iRNA composition, although in some examples, it may. Liposomes are useful for the transfer and delivery of active ingredients to the site of action. Because the liposomal membrane is structurally similar to biological membranes, when liposomes are applied to a tissue, the liposomal bilayer fuses with bilayer of the cellular membranes. As the merging of the liposome and cell progresses, the internal aqueous contents that include the iRNA are delivered into the cell where the iRNA can specifically bind to a target RNA and can mediate RNAi. In some cases the liposomes are also specifically targeted, e.g., to direct the iRNA to particular cell types.

A liposome containing a RNAi agent can be prepared by a variety of methods. In one example, the lipid component of a liposome is dissolved in a detergent so that micelles are formed with the lipid component. For example, the lipid component can be an amphipathic cationic lipid or lipid conjugate. The detergent can have a high critical micelle concentration and may be nonionic. Exemplary detergents include cholate, CHAPS, octylglucoside, deoxycholate, and lauroyl sarcosine. The RNAi agent preparation is then added to the micelles that include the lipid component. The cationic groups on the lipid interact with the RNAi agent and condense around the RNAi agent to form a liposome. After condensation, the detergent is removed, e.g., by dialysis, to yield a liposomal preparation of RNAi agent.

If necessary a carrier compound that assists in condensation can be added during the condensation reaction, e.g., by controlled addition. For example, the carrier compound can be a polymer other than a nucleic acid (e.g., spermine or spermidine). pH can also adjusted to favor condensation.

Methods for producing stable polynucleotide delivery vehicles, which incorporate a polynucleotide/cationic lipid complex as structural components of the delivery vehicle, are further described in, e.g., WO 96/37194, the entire contents of which are incorporated herein by reference. Liposome formation can also include one or more aspects of exemplary methods described in Felgner, P. L. et al., *Proc. Natl. Acad. Sci., USA.* 8:7413-7417, 1987; U.S. Pat. Nos. 4,897,355; 5,171,678: Bangham, et al. *M. Mol. Biol.* 23:238, 1965; Olson, et al. *Biochim. Biophys. Acta* 557:9, 1979; Szoka, et al. *Proc. Natl. Acad. Sci,* 75: 4194, 1978; Mayhew. et al. *Biochim. Biophys. Acta* 775:169, 1984; Kim, et al. *Biochim. Biophys. Acta* 728:339, 1983; and Fukunaga, et al. *Endocrinol.* 115:757, 1984. Commonly used techniques for preparing lipid aggregates of appropriate size for use as delivery vehicles include sonication and freeze-thaw plus extrusion (see. e.g., Mayer. et al. *Biochim. Biophys. Acta* 858:161, 1986). Microfluidization can be used when consistently small (50 to 200 nm) and relatively uniform aggregates are desired (Mayhew, et al. *Biochim. Biophys. Acta* 775:169, 1984). These methods are readily adapted to packaging RNAi agent preparations into liposomes.

Liposomes fall into two broad classes. Cationic liposomes are positively charged liposomes which interact with the negatively charged nucleic acid molecules to form a stable complex. The positively charged nucleic acid/liposome complex binds to the negatively charged cell surface and is internalized in an endosome. Due to the acidic pH within the endosome, the liposomes are ruptured, releasing their contents into the cell cytoplasm (Wang et al., *Biochem. Biophys. Res. Commun.,* 1987, 147, 980-985).

Liposomes which are pH-sensitive or negatively-charged, entrap nucleic acids rather than complex with it. Since both the nucleic acid and the lipid are similarly charged, repulsion rather than complex formation occurs. Nevertheless, some nucleic acid is entrapped within the aqueous interior of these liposomes. pH-sensitive liposomes have been used to deliver nucleic acids encoding the thymidine kinase gene to cell monolayers in culture. Expression of the exogenous gene was detected in the target cells (Zhou et al., *Journal of Controlled Release,* 1992, 19, 269-274).

One major type of liposomal composition includes phospholipids other than naturally-derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of phospholipid and/or phosphatidylcholine and/or cholesterol.

Examples of other methods to introduce liposomes into cells in vitro and in rivo include U.S. Pat. Nos. 5,283,185; 5,171,678; WO 94/00569; WO 93/24640; WO 91/16024; Felgner, *J. Biol. Chem.* 269:2550, 1994; Nabel, *Proc. Natl. Acad. Sci.* 90:11307, 1993; Nabel, *Human Gene Ther.* 3:649, 1992; Gershon, *Biochem.* 32:7143, 1993; and Strauss *EMBO J.* 11:417, 1992.

Non-ionic liposomal systems have also been examined to determine their utility in the delivery of drugs to the skin, in particular systems comprising non-ionic surfactant and cholesterol. Non-ionic liposomal formulations comprising Novasome™ I (glyceryl dilaurate/cholesterol/polyoxyethylene-10-stearyl ether) and Novasome™ II (glyceryl distearate/cholesterol/polyoxyethylene-10-stearyl ether) were used to deliver cyclosporin-A into the dermis of mouse skin. Results indicated that such non-ionic liposomal systems were effective in facilitating the deposition of cyclosporine A into different layers of the skin (Hu et al. *S.T.P.Pharma. Sci.,* 1994, 4(6) 466).

Liposomes also include "sterically stabilized" liposomes, a term which, as used herein, refers to liposomes comprising one or more specialized lipids that, when incorporated into liposomes, result in enhanced circulation lifetimes relative to liposomes lacking such specialized lipids. Examples of sterically stabilized liposomes are those in which part of the vesicle-forming lipid portion of the liposome (A) comprises one or more glycolipids, such as monosialoganglioside $G_{M1}$, or (B) is derivatized with one or more hydrophilic polymers, such as a polyethylene glycol (PEG) moiety. While not wishing to be bound by any particular theory, it is thought in the art that, at least for sterically stabilized liposomes containing gangliosides, sphingomyelin, or PEG-derivatized lipids, the enhanced circulation half-life of these sterically stabilized liposomes derives from a reduced uptake into cells of the reticuloendothelial system (RES) (Allen et al., *FEBS Letters,* 1987, 223, 42; Wu et al., *Cancer Research,* 1993, 53, 3765).

Various liposomes comprising one or more glycolipids are known in the art. Papahadjopoulos et al. (*Ann. N. Y. Acad. Sci.,* 1987, 507, 64) reported the ability of monosialoganglioside $G_{M1}$, galactocerebroside sulfate and phosphatidylinositol to improve blood half-lives of liposomes. These findings were expounded upon by Gabizon et al. (Proc. *Natl. Acad. Sci. U.S.A.,* 1988, 85, 6949). U.S. Pat. No. 4,837,028 and WO 88/04924, both to Allen et al., disclose liposomes comprising (1) sphingomyelin and (2) the ganglioside $G_{M1}$ or a galactocerebroside sulfate ester. U.S. Pat. No. 5,543,152 (Webb et al.) discloses liposomes comprising sphingomyelin. Liposomes comprising 1,2-sn-dimyristoylphosphatidylcholine are disclosed in WO 97/13499 (Lim et al).

In one embodiment, cationic liposomes are used. Cationic liposomes possess the advantage of being able to fuse to the cell membrane. Non-cationic liposomes, although not able to fuse as efficiently with the plasma membrane, are taken up by macrophages in vivo and can be used to deliver RNAi agents to macrophages.

Further advantages of liposomes include: liposomes obtained from natural phospholipids are biocompatible and biodegradable: liposomes can incorporate a wide range of water and lipid soluble drugs; liposomes can protect encapsulated RNAi agents in their internal compartments from metabolism and degradation (Rosoff, in "Pharmaceutical Dosage Forms." Lieberman, Rieger and Banker (Eds.), 1988, volume 1, p. 245). Important considerations in the preparation of liposome formulations are the lipid surface charge, vesicle size and the aqueous volume of the liposomes.

A positively charged synthetic cationic lipid, N-[1-(2,3-dioleyloxy)propyl]-N,N,N-trimethylammonium chloride (DOTMA) can be used to form small liposomes that interact spontaneously with nucleic acid to form lipid-nucleic acid complexes which are capable of fusing with the negatively charged lipids of the cell membranes of tissue culture cells, resulting in delivery of RNAi agent (see, e.g., Feigner, P. L. et al., Proc. Natl. Acad. Sci., USA 8:7413-7417, 1987 and U.S. Pat. No. 4,897,355 for a description of DOTMA and its use with DNA).

A DOTMA analogue, 1,2-bis(oleoyloxy)-3-(trimethylammonia)propane (DOTAP) can be used in combination with a phospholipid to form DNA-complexing vesicles. Lipofectin™ Bethesda Research Laboratories, Gaithersburg, Md.) is an effective agent for the delivery of highly anionic nucleic acids into living tissue culture cells that comprise positively charged DOTMA liposomes which interact spontaneously with negatively charged polynucleotides to form complexes. When enough positively charged liposomes are used, the net charge on the resulting complexes is also positive. Positively charged complexes prepared in this way spontaneously attach to negatively charged cell surfaces, fuse with the plasma membrane, and efficiently deliver functional nucleic acids into, for example, tissue culture cells. Another commercially available cationic lipid, 1,2-bis(oleoyloxy)-3,3-(trimethylammonia)propane ("DOTAP") (Boehringer Mannheim, Indianapolis, Ind.) differs from DOTMA in that the oleoyl moieties are linked by ester, rather than ether linkages.

Other reported cationic lipid compounds include those that have been conjugated to a variety of moieties including, for example, carboxyspermine which has been conjugated to one of two types of lipids and includes compounds such as 5-carboxyspermylglycine dioctaoleoylamide ("DOGS") (Transfectam™, Promega, Madison, Wis.) and dipalmitoyl-phosphatidylethanolamine 5-carboxyspermyl-amide ("DPPES") (see, e.g., U.S. Pat. No. 5,171,678).

Another cationic lipid conjugate includes derivatization of the lipid with cholesterol ("DC-Chol") which has been formulated into liposomes in combination with DOPE (See, Gao. X, and Huang, L., Biochim. Biophys. Res. Commun. 179:280, 1991). Lipopolylysine, made by conjugating polylysine to DOPE, has been reported to be effective for transfection in the presence of serum (Zhou, X. et al., Biochim. Biophys. Acta 1065:8, 1991). For certain cell lines, these liposomes containing conjugated cationic lipids, are said to exhibit lower toxicity and provide more efficient transfection than the DOTMA-containing compositions. Other commercially available cationic lipid products include DMRIE and DMRIE-HP (Vical, La Jolla, Calif.) and Lipofectamine (DOSPA) (Life Technology, Inc., Gaithersburg, Md.). Other cationic lipids suitable for the delivery of oligonucleotides are described in WO 98/39359 and WO 96/37194.

Liposomal formulations are particularly suited for topical administration, liposomes present several advantages over other formulations. Such advantages include reduced side effects related to high systemic absorption of the administered drug, increased accumulation of the administered drug at the desired target, and the ability to administer RNAi agent into the skin. In some implementations, liposomes are used for delivering RNAi agent to epidermal cells and also to enhance the penetration of RNAi agent into dermal tissues, e.g., into skin. For example, the liposomes can be applied topically. Topical delivery of drugs formulated as liposomes to the skin has been documented (see, e.g., Weiner et al., Journal of Drug Targeting, 1992, vol. 2,405-410 and du Plessis et al., Antiviral Research, 18, 1992, 259-265; Mannino, R. J. and Fould-Fogerite, S., Biotechniques 6:682-690, 1988; Itani, T. et al. Gene 56:267-276. 1987; Nicolau, C. et al. Meth. Enz. 149:157-176, 1987; Straubinger, R. M. and Papahadjopoulos. D. Meth. Enz. 101:512-527, 1983; Wang, C. Y. and Huang, L., Proc. Natl. Acad. Sci. USA 84:7851-7855, 1987).

Non-ionic liposomal systems have also been examined to determine their utility in the delivery of drugs to the skin, in particular systems comprising non-ionic surfactant and cholesterol. Non-ionic liposomal formulations comprising Novasome I (glyceryl dilaurate/cholesterol/polyoxyethylene-10-stearyl ether) and Novasome II (glyceryl distearate/cholesterol/polyoxyethylene-10-stearyl ether) were used to deliver a drug into the dermis of mouse skin. Such formulations with RNAi agent are useful for treating a dermatological disorder.

Liposomes that include iRNA can be made highly deformable. Such deformability can enable the liposomes to penetrate through pore that are smaller than the average radius of the liposome. For example, transferosomes are a type of deformable liposomes. Transferosomes can be made by adding surface edge activators, usually surfactants, to a standard liposomal composition. Transferosomes that include RNAi agent can be delivered, for example, subcutaneously by infection in order to deliver RNAi agent to keratinocytes in the skin. In order to cross intact mammalian skin, lipid vesicles must pass through a series of fine pores, each with a diameter less than 50 nm, under the influence of a suitable transdermal gradient. In addition, due to the lipid properties, these transferosomes can be self-optimizing (adaptive to the shape of pores, e.g., in the skin), self-repairing, and can frequently reach their targets without fragmenting, and often self-loading.

Other formulations amenable to the present invention are described in U.S. provisional application Ser. No. 61/018,616, filed Jan. 2, 2008; 61/018,611, filed Jan. 2, 2008; 61/039,748, filed Mar. 26, 2008; 61/047,087, filed Apr. 22, 2008 and 61/051,528, filed May 8, 2008. PCT application no PCT/US2007/080331, filed Oct. 3, 2007 also describes formulations that are amenable to the present invention.

Transferosomes are yet another type of liposomes, and are highly deformable lipid aggregates which are attractive candidates for drug delivery vehicles. Transferosomes can be described as lipid droplets which are so highly deformable that they are easily able to penetrate through pores which are smaller than the droplet. Transferosomes are adaptable to the environment in which they are used, e.g., they are self-optimizing (adaptive to the shape of pores in the skin), self-repairing, frequently reach their targets without fragmenting, and often self-loading. To make transferosomes it is possible to add surface edge-activators, usually surfactants, to a standard liposomal composition. Transferosomes have been used to deliver serum albumin to the skin. The transferosome-mediated delivery of serum albumin has been shown to be as effective as subcutaneous injection of a solution containing serum albumin.

Surfactants find wide application in formulations such as emulsions (including microemulsions) and liposomes. The most common way of classifying and ranking the properties of the many different types of surfactants, both natural and synthetic, is by the use of the hydrophile/lipophile balance (HLB). The nature of the hydrophilic group (also known as the "head") provides the most useful means for categorizing the different surfactants used in formulations (Rieger, in Pharmaceutical Dosage Forms, Marcel Dekker, Inc., New York. N.Y., 1988, p. 285).

If the surfactant molecule is not ionized, it is classified as a nonionic surfactant. Nonionic surfactants find wide application in pharmaceutical and cosmetic products and are usable over a wide range of pH values. In general their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxyethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfosuccinates, and phosphates. The most important members of the anionic surfactant class are the alkyl sulfates and the soaps.

If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric. Amphoteric surfactants include acrylic acid derivatives, substituted alkylamides, N-alkylbetaines and phosphatides.

The use of surfactants in drug products, formulations and in emulsions has been reviewed (Rieger, in Pharmaceutical Dosage Forms, Marcel Dekker, Inc., New York, N.Y., 1988, p. 285).

The iRNA for use in the methods of the invention can also be provided as micellar formulations. "Micelles" are defined herein as a particular type of molecular assembly in which amphipathic molecules are arranged in a spherical structure such that all the hydrophobic portions of the molecules are directed inward, leaving the hydrophilic portions in contact with the surrounding aqueous phase. The converse arrangement exists if the environment is hydrophobic.

A mixed micellar formulation suitable for delivery through transdermal membranes may be prepared by mixing an aqueous solution of the siRNA composition, an alkali metal $C_8$ to $C_{22}$ alkyl sulphate, and a micelle forming compounds. Exemplary micelle forming compounds include lecithin, hyaluronic acid, pharmaceutically acceptable salts of hyaluronic acid, glycolic acid, lactic acid, chamomile extract, cucumber extract, oleic acid, linoleic acid, linolenic acid, monoolein, monooleates, monolaurates, borage oil, evening of primrose oil, menthol, trihydroxy oxo cholanyl glycine and pharmaceutically acceptable salts thereof, glycerin, polyglycerin, lysine, polylysine, triolein, polyoxyethylene ethers and analogues thereof, polidocanol alkyl ethers and analogues thereof, chenodeoxycholate, deoxycholate, and mixtures thereof. The micelle forming compounds may be added at the same time or after addition of the alkali metal alkyl sulphate. Mixed micelles will form with substantially any kind of mixing of the ingredients but vigorous mixing in order to provide smaller size micelles.

In one method a first micellar composition is prepared which contains the siRNA composition and at least the alkali metal alkyl sulphate. The first micellar composition is then mixed with at least three micelle forming compounds to form a mixed micellar composition. In another method, the micellar composition is prepared by mixing the siRNA composition, the alkali metal alkyl sulphate and at least one of the micelle forming compounds, followed by addition of the remaining micelle forming compounds, with vigorous mixing.

Phenol and/or m-cresol may be added to the mixed micellar composition to stabilize the formulation and protect against bacterial growth. Alternatively, phenol and/or m-cresol may be added with the micelle forming ingredients. An isotonic agent such as glycerin may also be added after formation of the mixed micellar composition.

For delivery of the micellar formulation as a spray, the formulation can be put into an aerosol dispenser and the dispenser is charged with a propellant. The propellant, which is under pressure, is in liquid form in the dispenser. The ratios of the ingredients are adjusted so that the aqueous and propellant phases become one, i.e., there is one phase. If there are two phases, it is necessary to shake the dispenser prior to dispensing a portion of the contents, e.g., through a metered valve. The dispensed dose of pharmaceutical agent is propelled from the metered valve in a fine spray.

Propellants may include hydrogen-containing chlorofluorocarbons, hydrogen-containing fluorocarbons, dimethyl ether and diethyl ether. In certain embodiments, HFA 134a (1,1,1,2 tetrafluoroethane) may be used.

The specific concentrations of the essential ingredients can be determined by relatively straightforward experimentation. For absorption through the oral cavities, it is often desirable to increase, e.g., at least double or triple, the dosage for through injection or administration through the gastrointestinal tract.

Lipid Particles

The iRNAs, e.g., dsRNAs of in the invention may be fully encapsulated in a lipid formulation, e.g., a LNP, or other nucleic acid-lipid particle.

As used herein, the term "LNP" refers to a stable nucleic acid-lipid particle. LNPs contain a cationic lipid, a non-cationic lipid, and a lipid that prevents aggregation of the particle (e.g., a PEG-lipid conjugate). LNPs are extremely useful for systemic applications, as they exhibit extended circulation lifetimes following intravenous (i.v.) injection and accumulate at distal sites (e.g., sites physically separated from the administration site). LNPs include "pSPLP," which include an encapsulated condensing agent-nucleic acid complex as set forth in PCT Publication No. WO 00/03683. The particles of the present invention typically have a mean diameter of about 50 nm to about 150 nm, more typically about 60 nm to about 130 nm, more typically about 70 nm to about 110 nm, most typically about 70 nm to about 90 nm, and are substantially nontoxic. In addition, the nucleic acids when present in the nucleic acid-lipid particles of the present invention are resistant in aqueous solution to degradation with a nuclease. Nucleic acid-lipid particles and their method of preparation are disclosed in, e.g., U.S. Pat. Nos. 5,976,567; 5,981,501; 6,534,484; 6,586,410; 6,815,432; U.S. Publication No. 2010/0324120 and PCT Publication No. WO 96/40964.

In one embodiment, the lipid to drug ratio (mass/mass ratio) (e.g., lipid to dsRNA ratio) will be in the range of from about 1:1 to about 50:1, from about 1:1 to about 25:1, from about 3:1 to about 15:1, from about 4:1 to about 10:1, from about 5:1 to about 9:1, or about 6:1 to about 9:1. Ranges intermediate to the above recited ranges are also contemplated to be part of the invention.

The cationic lipid can be, for example N,N-dioleyl-N,N-dimethylammonium chloride (DODAC). N,N-distearyl-N, N-dimethylammonium bromide (DDAB), N-(I-(2,3-dioleoyloxy)propyl)-N,N,N-trimethylammonium chloride (DOTAP), N-(I-(2,3-dioleyloxy)propyl)-N,N,N-trimethylammonium chloride (DOTMA), N,N-dimethyl-2,3-dioleyloxy)propylamine (DODMA), 1,2-DiLinoleyloxy-N,N-dimethylaminopropane (DLinDMA), 1,2-Dilinolenyloxy-N,N-dimethylaminopropane (DLenDMA), 1,2-Dilinoleylcarbamoyloxy-3-dimethylaminopropane (DLin-C-DAP), 1,2-Dilinoleyoxy-3-(dimethylamino) acetoxypropane (DLin-DAC), 1,2-Dilinoleyoxy-3-morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-Dilinoleyloxy-3-trimethylaminopropane chloride salt (DLin-TMA.Cl), 1,2-Dilinoleoyl-3-trimethylaminopropane chloride salt (DLin-TAP.Cl), 1,2-Dilinoleyloxy-3-(N-methylpiperazino)propane (DLin-MPZ), or 3-(N,N-Dilinoleylamino)-1,2-propanediol (DLinAP), 3-(N,N-Dioleylamino)-1,2-propanedio (DOAP), 1,2-Dilinoleyloxo-3-(2-N,N-dimethylamino)ethoxypropane (DLin-EG-DMA), 1,2-Dilinolenyloxy-N,N-dimethylaminopropane (DLinDMA), 2,2-Dilinoleyl-4-dimethylaminomethyl-[1,3]-dioxolane (DLin-K-DMA) or analogs thereof, (3aR,5s,6aS)-N,N-dimethyl-2,2-di((9Z,12Z)-octadeca-9,12-dienyl)tetrahydro-3aH-cyclopenta[d][,3]dioxol-5-amine (ALN 100), (6Z,9Z,28Z,31Z)-heptatriaconta-6,9,28,31-tetraen-19-yl 4-(dimethylamino)butanoate (MC3), 1,1'-(2-(4-(2-((2-(bis (2-hydroxydodecyl)amino)ethyl)(2-hydroxydodecyl)amino) ethyl)piperazin-1-yl)ethylazanediyl)didodecan-2-ol (Tech G1), or a mixture thereof. The cationic lipid can comprise from about 20 mol % to about 50 mol % or about 40 mol % of the total lipid present in the particle.

In another embodiment, the compound 2,2-Dilinoleyl-4-dimethylaminoethyl-[1,3]-dioxolane can be used to prepare lipid-siRNA nanoparticles. Synthesis of 2,2-Dilinoleyl-4-dimethylaminoethyl-[1,3]-dioxolane is described in International application no. PCT/US2009/061897, published as WO/2010/048536, which is herein incorporated by reference.

In one embodiment, the lipid-siRNA particle includes 40% 2, 2-Dilinoleyl-4-dimethylaminoethyl-[1,3]-dioxolane: 10% DSPC: 40% Cholesterol: 10% PEG-C-DOMG (mole percent) with a particle size of 63.0±20 nm and a 0.027 siRNA/Lipid Ratio.

The ionizable/non-cationic lipid can be an anionic lipid or a neutral lipid including, but not limited to, distearoylphosphatidylcholine (DSPC), dioleoylphosphatidylcholine (DOPC), dipalmitoylphosphatidylcholine (DPPC), dioleoyl-phosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoylphosphatidylethanolamine (POPE), dioleoyl-phosphatidylethanolamine 4-(N-maleimidomethyl)-cyclohexane-1-carboxylate (DOPE-mal), dipalmitoyl phosphatidyl ethanolamine (DPPE), dimyristoylphosphoethanolamine (DMPE), distearoyl-phosphatidyl-ethanolamine (DSPE), 16-O-monomethyl PE, 16-O-dimethyl PE, 18-1-trans PE, 1-stearoyl-2-oleoyl-phosphatidyethanolamine (SOPE), cholesterol, or a mixture thereof. The non-cationic lipid can be from about 5 mol % to about 90 mol %, about 10 mol %, or about 58 mol % if cholesterol is included, of the total lipid present in the particle.

The conjugated lipid that inhibits aggregation of particles can be, for example, a polyethyleneglycol (PEG)-lipid including, without limitation, a PEG-diacylglycerol (DAG), a PEG-dialkyloxypropyl (DAA), a PEG-phospholipid, a PEG-ceramide (Cer), or a mixture thereof. The PEG-DAA conjugate can be, for example, a PEG-dilauryloxypropyl ($C_{12}$), a PEG-dimyristyloxypropyl ($C_{14}$), a PEG-dipalmityloxypropyl ($C_{16}$), or a PEG-distearyloxypropyl ($C_{18}$). The conjugated lipid that prevents aggregation of particles can be from 0 mol % to about 20 mol % or about 2 mol % of the total lipid present in the particle.

In some embodiments, the nucleic acid-lipid particle further includes cholesterol at, e.g., about 10 mol % to about 60 mol % or about 48 mol % of the total lipid present in the particle.

In one embodiment, the lipidoid ND98.4HCl (MW 1487) (see U.S. patent application Ser. No. 12/056,230, filed Mar. 26, 2008, which is incorporated herein by reference), Cholesterol (Sigma-Aldrich), and PEG-Ceramide C16 (Avanti Polar Lipids) can be used to prepare lipid-dsRNA nanoparticles (i.e., LNP01 particles). Stock solutions of each in ethanol can be prepared as follows: ND98, 133 mg/ml; Cholesterol, 25 mg/ml, PEG-Ceramide C16, 100 mg/ml. The ND98, Cholesterol, and PEG-Ceramide C16 stock solutions can then be combined in a, e.g., 42:48:10 molar ratio. The combined lipid solution can be mixed with aqueous dsRNA (e.g., in sodium acetate pH 5) such that the final ethanol concentration is about 35-45% and the final sodium acetate concentration is about 100-300 mM. Lipid-dsRNA nanoparticles typically form spontaneously upon mixing. Depending on the desired particle size distribution, the resultant nanoparticle mixture can be extruded through a polycarbonate membrane (e.g., 100 nm cut-off) using, for example, a thermobarrel extruder, such as Lipex Extruder (Northern Lipids, Inc). In some cases, the extrusion step can be omitted. Ethanol removal and simultaneous buffer exchange can be accomplished by, for example, dialysis or tangential flow filtration. Buffer can be exchanged with, for example, phosphate buffered saline (PBS) at about pH 7, e.g., about pH 6.9, about pH 7.0, about pH 7.1, about pH 7.2, about pH 7.3, or about pH 7.4. LNP01 formulations are described, e.g., in International Application Publication No. WO 2008/042973, which is hereby incorporated by reference.

Additional exemplary lipid-dsRNA formulations are described in Table A.

TABLE A

Exemplary lipid dsRNA formulations

| | Ionizable/Cationic Lipid | cationic lipid/non-cationic lipid/cholesterol/PEG-lipid conjugate Lipid:siRNA ratio |
|---|---|---|
| LNP_DLinDMA | 1,2-Dilinolenyloxy-N,N-dimethylaminopropane (DLinDMA) | DLinDMA/DPPC/Cholesterol/PEG-cDMA (57.1/7.1/34.4/1.4) lipid:siRNA ~7:1 |
| 2-XTC | 2,2-Dilinoleyl-4-dimethylaminoethyl-[1,3]-dioxolane (XTC) | XTC/DPPC/Cholesterol/PEG-cDMA 57.1/7.1/34.4/1.4 lipid:siRNA ~7:1 |
| LNP05 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA ~6:1 |
| LNP06 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA ~11:1 |
| LNP07 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA ~6:1 |
| LNP08 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA ~11:1 |
| LNP09 | 2,2-Dilinoleyl-4-dimethylaminoethyl-[1,3]-dioxolane (XTC) | XTC/DSPC/Cholesterol/PEG-DMG 50/10/38.5/1.5 lipid:siRNA 10:1 |
| LNP10 | (3aR,5s,6aS)-N,N-dimethyl-2,2-di((9Z,12Z)-octadeca-9,12-dienyl)tetrahydro-3aH-cyclopenta[d][1,3]dioxol-5-amine (ALN100) | ALN100/DSPC/Cholesterol/PEG-DMG 50/10/38.5/1.5 Lipid:siRNA 10:1 |
| LNP11 | (6Z,9Z,28Z,31Z)-heptatriaconta-6,9,28,31-tetraen-19-yl 4-(dimethylamino)butanoate (MC3) | MC-3/DSPC/Cholesterol/PEG-DMG 50/10/38.5/1.5 Lipid:siRNA 10:1 |
| LNP12 | 1,1'-(2-(4-(2-((2-(bis(2-hydroxydodecyl)amino)ethyl)(2-hydroxydodecyl)amino)ethyl)piperazin-1-yl)ethylazanediyl)didodecan-2-ol (C12-200> | Tech G1/DSPC/Cholesterol/PEG-DMG 50/10/38.5/1.5 Lipid:siRNA 10:1 |
| LNP13 | XTC | XTC/DSPC/Chol/PEG-DMG 50/10/38.5/1.5 Lipid:siRNA: 33:1 |
| LNP14 | MC3 | MC3/DSPC/Chol/PEG-DMG 40/15/40/5 Lipid:siRNA: 11:1 |
| LNP15 | MC3 | MC3/DSPC/Chol/PEG-DSG/GalNAc-PEG-DSG 50/10/35/4.5/0.5 Lipid:siRNA: 11:1 |
| LNP16 | MC3 | MC3/DSPC/Chol/PEG-DMG 50/10/38.5/1.5 Lipid:siRNA: 7:1 |
| LNP17 | MC3 | MC3/DSPC/Chol/PEG-DSG 50/10/38.5/1.5 Lipid:siRNA: 10:1 |
| LNP18 | MC3 | MC3/DSPC/Chol/PEG-DMG 50/10/38.5/1.5 Lipid:siRNA: 12:1 |
| LNP19 | MC3 | MC3/DSPC/Chol/PEG-DMG 50/10/35/5 Lipid:siRNA: 8:1 |
| LNP20 | MC3 | MC3/DSPC/Chol/PEG-DPG 50/10/38.5/1.5 Lipid:siRNA: 10:1 |
| LNP21 | C12-200 | C12-200/DSPC/Chol/PEG-DSG 50/10/38.5/1.5 Lipid:siRNA: 7:1 |
| LNP22 | XTC | XTC/DSPC/Chol/PEG-DSG 50/10/38.5/1.5 Lipid:siRNA: 10:1 |

Abbreviations in Table A include the following: DSPC: distearoylphosphatidylcholine; DPPC: dipalmitoylphosphatidylcholine: PEG-DMG: PEG-didimyristoyl glycerol (C14-PEG, or PEG-C14) (PEG with avg mol wt of 2000); PEG-DSG: PEG-distyryl glycerol (C18-PEG, or PEG-C18) (PEG with avg mol wt of 2000); PEG-cDMA: PEG-carbamoyl-1,2-dimyristyloxypropylamine (PEG with avg mol wt of 2000).

DLinDMA (1,2-Dilinolenyloxy-N,N-dimethylaminopropane) comprising formulations are described in International Publication No. WO2009/127060, filed Apr. 15, 2009, which is hereby incorporated by reference.

XTC comprising formulations are described, e.g., in U.S. Provisional Ser. No. 61/148,366, filed Jan. 29, 2009; U.S. Provisional Ser. No. 61/156,851, filed Mar. 2, 2009; U.S. Provisional Serial No. filed Jun. 10, 2009; U.S. Provisional Ser. No. 61/228,373, filed Jul. 24, 2009; U.S. Provisional Ser. No. 61/239,686, filed Sep. 3, 2009, and International Application No. PCT/US2010/022614, filed Jan. 29, 2010, which are hereby incorporated by reference.

MC3 comprising formulations are described, e.g., in U.S. Publication No. 2010/0324120, filed Jun. 10, 2010, the entire contents of which are hereby incorporated by reference.

ALNY-100 comprising formulations are described, e.g., International patent application number PCT/US09/63933, filed on Nov. 10, 2009, which is hereby incorporated by reference.

C12-200 comprising formulations are described in U.S. Provisional Ser. No. 61/175,770, filed May 5, 2009 and International Application No. PCT/US10/33777, filed May 5, 2010, which are hereby incorporated by reference.

Additional Formulations i. Emulsions

The compositions of the present invention can be prepared and formulated as emulsions. Emulsions are typically heterogeneous systems of one liquid dispersed in another in the form of droplets usually exceeding 0.1 μm in diameter (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988. Marcel Dekker, Inc., New York, N.Y., volume 1, p. 199; Rosoff, in Pharmaceutical Dosage Forms, Lieberman, Rieger and Banker (Eds.), 1988. Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York. N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions can be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions can contain additional components in addition to the dispersed phases, and the active drug which can be present as a solution in either the aqueous phase, oily phase or itself as a separate phase. Pharmaceutical excipients such as emulsifiers, stabilizers, dyes, and anti-oxidants can also be present in emulsions as needed. Pharmaceutical emulsions can also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Either of the phases of the emulsion can be a semisolid or a solid, as is the case of emulsion-style ointment bases and creams. Other means of stabilizing emulsions entail the use of emulsifiers that can be incorporated into either phase of the emulsion. Emulsifiers can broadly be classified into four categories: synthetic surfactants, naturally occurring emulsifiers, absorption bases, and finely dispersed solids (see e.g., Ansel's Pharmaceutical Dosage Forms and Drug Delivery Systems, Allen, L V., Popovich N G., and Ansel H C., 2004, Lippincott Williams & Wilkins (8th ed.), New York. N.Y.; Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants can be classified into different classes based on the nature of the hydrophilic group: nonionic, anionic, cationic and amphoteric (see e.g., Ansel's Pharmaceutical Dosage Forms and Drug Delivery Systems, Allen, L V., Popovich N G., and Ansel H C., 2004, Lippincott Williams & Wilkins (8th ed.), New York. N.Y. Rieger, in Pharmaceutical Dosage Forms, Lieberman, Rieger and Banker (Eds.), 1988, Marcel Dekker, Inc., New York, N.Y., volume 1, p. 285).

Naturally occurring emulsifiers used in emulsion formulations include lanolin, beeswax, phosphatides, lecithin and acacia. Absorption bases possess hydrophilic properties such that they can soak up water to form w/o emulsions yet retain their semisolid consistencies, such as anhydrous lanolin and hydrophilic petrolatum. Finely divided solids have also been used as good emulsifiers especially in combination with surfactants and in viscous preparations. These include polar inorganic solids, such as heavy metal hydroxides, nonswelling clays such as bentonite, attapulgite, hectorite, kaolin, montmorillonite, colloidal aluminum silicate and colloidal magnesium aluminum silicate, pigments and nonpolar solids such as carbon or glyceryl tristearate.

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

Hydrophilic colloids or hydrocolloids include naturally occurring gums and synthetic polymers such as polysaccharides (for example, acacia, agar, alginic acid, carrageenan, guar gum, karaya gum, and tragacanth), cellulose derivatives (for example, carboxymethylcellulose and carboxypropylcellulose), and synthetic polymers (for example, carbomers, cellulose ethers, and carboxyvinyl polymers). These disperse or swell in water to form colloidal solutions that stabilize emulsions by forming strong interfacial films around the dispersed-phase droplets and by increasing the viscosity of the external phase.

Since emulsions often contain a number of ingredients such as carbohydrates, proteins, sterols and phosphatides that can readily support the growth of microbes, these formulations often incorporate preservatives. Commonly used preservatives included in emulsion formulations include methyl paraben, propyl paraben, quaternary ammonium salts, benzalkonium chloride, esters of p-hydroxybenzoic acid, and boric acid. Antioxidants are also commonly added to emulsion formulations to prevent deterioration of the formulation. Antioxidants used can be free radical scavengers such as tocopherols, alkyl gallates, butylated hydroxyanisole, butylated hydroxytoluene, or reducing agents such as ascorbic acid and sodium metabisulfite, and antioxidant synergists such as citric acid, tartaric acid, and lecithin.

The application of emulsion formulations via dermatological, oral and parenteral routes and methods for their manufacture have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.). New York, N.Y.; Idson, in Pharmaceutical Dosage Forms, Lieberman, Rieger and Banker (Eds.), 1988, Marcel Dekker, Inc., New York, N.Y., volume 1, p. 199). Emulsion formulations for oral delivery have been very widely used because of ease of formulation, as well as efficacy from an absorption and bioavailability standpoint (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988. Marcel Dekker, Inc., New York, N.Y., volume 1, p. 245; Idson, in Pharmaceutical Dosage Forms, Lieberman, Rieger and Banker (Eds.), 1988, Marcel Dekker, Inc., New York, N.Y., volume 1, p. 199). Mineral-oil base laxatives, oil-soluble vitamins and high fat nutritive preparations are among the materials that have commonly been administered orally as o/w emulsions.

ii. Microemulsions

In one embodiment of the present invention, the compositions of iRNAs and nucleic acids are formulated as microemulsions. A microemulsion can be defined as a system of water, oil and amphiphile which is a single optically isotropic and thermodynamically stable liquid solution (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245). Typically microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215). Microemulsions commonly are prepared via a combination of three to five components that include oil, water, surfactant, cosurfactant and electrolyte. Whether the microemulsion is of the water-in-oil (w/o) or an oil-in-water (o/w) type is dependent on the properties of the oil and surfactant used and on the structure and geometric packing of the polar heads and hydrocarbon tails of the surfactant molecules (Schott, in Remington's Pharmaceutical Sciences, Mack Publishing Co., Easton, Pa., 1985, p. 271).

The phenomenological approach utilizing phase diagrams has been extensively studied and has yielded a comprehensive knowledge, to one skilled in the art, of how to formulate microemulsions (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245; Block, in Pharmaceutical Dosage Forms, Lieberman, Rieger and Banker (Eds.), 1988, Marcel Dekker, Inc., New York, N.Y., volume 1, p. 335). Compared to conventional emulsions, microemulsions offer the advantage of solubilizing water-insoluble drugs in a formulation of thermodynamically stable droplets that are formed spontaneously.

Surfactants used in the preparation of microemulsions include, but are not limited to, ionic surfactants, non-ionic surfactants. Brij 96, polyoxyethylene oleyl ethers, polyglycerol fatty acid esters, tetraglycerol monolaurate (ML310), tetraglycerol monooleate (MO310), hexaglycerol monooleate (PO310), hexaglycerol pentaoleate (PO500), decaglycerol monocaprate (MCA750), decaglycerol monooleate (MO750), decaglycerol sequioleate (SO750), decaglycerol decaoleate (DAO750), alone or in combination with cosurfactants. The cosurfactant, usually a short-chain alcohol such as ethanol, 1-propanol, and 1-butanol, serves to increase the interfacial fluidity by penetrating into the surfactant film and consequently creating a disordered film because of the void space generated among surfactant molecules. Microemulsions can, however, be prepared without the use of cosurfactants and alcohol-free self-emulsifying microemulsion systems are known in the art. The aqueous phase can typically be, but is not limited to, water, an aqueous solution of the drug, glycerol, PEG300, PEG400, polyglycerols, propylene glycols, and derivatives of ethylene glycol. The oil phase can include, but is not limited to, materials such as Captex 300, Captex 355, Capmul MCM, fatty acid esters, medium chain (C8-C12) mono, di, and tri-glycerides, polyoxyethylated glyceryl fatty acid esters, fatty alcohols, polyglycolized glycerides, saturated polyglycolized C8-C10 glycerides, vegetable oils and silicone oil.

Microemulsions are particularly of interest from the standpoint of drug solubilization and the enhanced absorption of drugs. Lipid based microemulsions (both o/w and w/o) have been proposed to enhance the oral bioavailability of drugs, including peptides (see e.g., U.S. Pat. Nos. 6,191, 105; 7,063,860; 7,070,802; 7,157,099; Constantinides et al., *Pharmaceutical Research,* 1994, 11, 1385-1390; Ritschel, *Meth. Find. Exp. Clin. Pharmacol.,* 1993, 13, 205). Microemulsions afford advantages of improved drug solubilization, protection of drug from enzymatic hydrolysis, possible enhancement of drug absorption due to surfactant-induced alterations in membrane fluidity and permeability, ease of preparation, ease of oral administration over solid dosage forms, improved clinical potency, and decreased toxicity (see e.g., U.S. Pat. Nos. 6,191,105; 7,063,860; 7,070,802; 7,157,099; Constantinides et al., *Pharmaceutical Research,* 1994, 11, 1385; Ho et al., *J. Pharm. Sci.,* 1996, 85, 138-143). Often microemulsions can form spontaneously when their components are brought together at ambient temperature. This can be particularly advantageous when formulating thermolabile drugs, peptides or iRNAs. Microemulsions have also been effective in the transdermal delivery of active components in both cosmetic and pharmaceutical applications. It is expected that the microemulsion compositions and formulations of the present invention will facilitate the increased systemic absorption of iRNAs and nucleic acids from the gastrointestinal tract, as well as improve the local cellular uptake of iRNAs and nucleic acids.

Microemulsions of the present invention can also contain additional components and additives such as sorbitan monostearate (Grill 3), Labrasol, and penetration enhancers to improve the properties of the formulation and to enhance the absorption of the iRNAs and nucleic acids of the present invention. Penetration enhancers used in the microemulsions of the present invention can be classified as belonging to one of five broad categories—surfactants, fatty acids, bile salts, chelating agents, and non-chelating non-surfactants (Lee et al., Critical Reviews in Therapeutic Drug Carrier Systems, 1991, p. 92). Each of these classes has been discussed above.

iii. Micronparticles

An RNAi agent of the invention may be incorporated into a particle, e.g., a microparticle. Microparticles can be produced by spray-drying, but may also be produced by other methods including lyophilization, evaporation, fluid bed drying, vacuum drying, or a combination of these techniques.

iv. Penetration Enhancers

In one embodiment, the present invention employs various penetration enhancers to effect the efficient delivery of nucleic acids, particularly iRNAs, to the skin of animals. Most drugs are present in solution in both ionized and nonionized forms. However, usually only lipid soluble or lipophilic drugs readily cross cell membranes. It has been discovered that even non-lipophilic drugs can cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers can be classified as belonging to one of five broad categories, i.e., surfactants, fatty acids, bile salts, chelating agents, and non-chelating non-surfactants (see e.g., Malmsten, M. Surfactants and polymers in drug delivery, Informa Health Care, New York, N.Y., 2002; Lee et al., Critical Reviews in Therapeutic Drug Carrier Systems, 1991, p. 92). Each of the above mentioned classes of penetration enhancers are described below in greater detail.

Surfactants (or "surface-active agents") are chemical entities which, when dissolved in an aqueous solution, reduce the surface tension of the solution or the interfacial tension between the aqueous solution and another liquid, with the result that absorption of iRNAs through the mucosa is enhanced. In addition to bile salts and fatty acids, these penetration enhancers include, for example, sodium lauryl sulfate, polyoxyethylene-9-lauryl ether and polyoxyethylene-20-cetyl ether) (see e.g., Malmsten, M. Surfactants and polymers in drug delivery, Informa Health Care, New York, N.Y., 2002; Lee et al., Critical Reviews in Therapeutic Drug Carrier Systems, 1991, p. 92); and perfluorochemical emulsions, such as FC-43. Takahashi et al., J. Pharm. Pharmacol., 1988, 40, 252).

Various fatty acids and their derivatives which act as penetration enhancers include, for example, oleic acid, lauric acid, capric acid (n-decanoic acid), myristic acid, palmitic acid, stearic acid, linoleic acid, linolenic acid, dicaprate, tricaprate, monoolein (1-monooleoyl-rac-glycerol), dilaurin, caprylic acid, arachidonic acid, glycerol 1-monocaprate, 1-dodecylazacycloheptan-2-one, acylcarnitines, acylcholines, $C_{1-20}$ alkyl esters thereof (e.g., methyl, isopropyl and t-butyl), and mono- and di-glycerides thereof (i.e., oleate, laurate, caprate, myristate, palmitate, stearate, linoleate, etc.) (see e.g., Touitou, E., et al. Enhancement in Drug Delivery. CRC Press, Danvers, Mass., 2006; Lee et al., Critical Reviews in Therapeutic Drug Carrier Systems, 1991, p. 92; Muranishi, Critical Reviews in Therapeutic Drug Carrier Systems, 1990, 7, 1-33; El Hariri et al., J. Pharm. Pharmacol., 1992, 44, 651-654).

The physiological role of bile includes the facilitation of dispersion and absorption of lipids and fat-soluble vitamins (see e.g., Malmsten, M. Surfactants and polymers in drug delivery, Informa Health Care, New York, N.Y., 2002; Brunton, Chapter 38 in: Goodman & Gilman's The Pharmacological Basis of Therapeutics, 9th Ed., Hardman et al. Eds., McGraw-Hill, New York, 1996, pp. 934-935). Various natural bile salts, and their synthetic derivatives, act as penetration enhancers. Thus the term "bile salts" includes any of the naturally occurring components of bile as well as any of their synthetic derivatives. Suitable bile salts include, for example, cholic acid (or its pharmaceutically acceptable sodium salt, sodium cholate), dehydrocholic acid (sodium dehydrocholate), deoxycholic acid (sodium deoxycholate), glucholic acid (sodium glucholate), glycholic acid (sodium glycocholate), glycodeoxycholic acid (sodium glycodeoxycholate), taurocholic acid (sodium taurocholate), taurodeoxycholic acid (sodium taurodeoxycholate), chenodeoxycholic acid (sodium chenodeoxycholate), ursodeoxycholic acid (UDCA), sodium tauro-24,25-dihydro-fusidate (STDHF), sodium glycodihydrofusidate and polyoxyethylene-9-lauryl ether (POE) (see e.g., Malmsten, M. Surfactants and polymers in drug delivery, Informa Health Care, New York, N.Y., 2002; Lee et al., Critical Reviews in Therapeutic Drug Carrier Systems, 1991, page 92; Swinyard, Chapter 39 In: Remington's Pharmaceutical Sciences, 18th Ed., Gennaro, ed., Mack Publishing Co., Easton, Pa., 1990, pages 782-783; Muranishi, Critical Reviews in Therapeutic Drug Carrier Systems, 1990, 7, 1-33; Yamamoto et al., J. Pharm. Exp. Ther., 1992, 263, 25; Yamashita et al., J. Pharm. Sci., 1990, 79, 579-583).

Chelating agents, as used in connection with the present invention, can be defined as compounds that remove metallic ions from solution by forming complexes therewith, with the result that absorption of iRNAs through the mucosa is enhanced. With regards to their use as penetration enhancers in the present invention, chelating agents have the added advantage of also serving as DNase inhibitors, as most characterized DNA nucleases require a divalent metal ion for catalysis and are thus inhibited by chelating agents (Jarrett, J. Chromatogr., 1993, 618, 315-339). Suitable chelating agents include but are not limited to disodium ethylenediaminetetraacetate (EDTA), citric acid, salicylates (e.g., sodium salicylate, 5-methoxysalicylate and homovanilate), N-acyl derivatives of collagen, laureth-9 and N-amino acyl derivatives of beta-diketones (enamines) (see e.g., Katdare, A. et al., Excipient development for pharmaceutical, biotechnology, and drug delivery, CRC Press, Danvers, Mass., 2006: Lee et al., Critical Reviews in Therapeutic Drug Carrier Systems, 1991, page 92; Muranishi, Critical Reviews in Therapeutic Drug Carrier Systems, 1990, 7, 1-33; Buur et al., J. Control Rel., 1990, 14, 43-51).

As used herein, non-chelating non-surfactant penetration enhancing compounds can be defined as compounds that demonstrate insignificant activity as chelating agents or as surfactants but that nonetheless enhance absorption of iRNAs through the alimentary mucosa (see e.g., Muranishi, Critical Reviews in Therapeutic Drug Carrier Systems, 1990, 7, 1-33). This class of penetration enhancers includes, for example, unsaturated cyclic ureas, 1-alkyl- and 1-alkenylazacyclo-alkanone derivatives (Lee et al., Critical Reviews in Therapeutic Drug Carrier Systems, 1991, page 92); and non-steroidal anti-inflammatory agents such as diclofenac sodium, indomethacin and phenylbutazone (Yamashita et al., *J. Pharm. Pharmacol.*, 1987, 39, 621-626).

Agents that enhance uptake of iRNAs at the cellular level can also be added to the pharmaceutical and other compositions of the present invention. For example, cationic lipids, such as lipofectin (Junichi et al, U.S. Pat. No. 5,705,188), cationic glycerol derivatives, and polycationic molecules, such as polylysine (Lollo et al., PCT Application WO 97/30731), are also known to enhance the cellular uptake of dsRNAs. Examples of commercially available transfection reagents include, for example Lipofectamine™ (Invitrogen; Carlsbad, Calif.), Lipofectamine 2000™ (Invitrogen; Carlsbad, Calif.), 293Fectin™ (Invitrogen; Carlsbad. Calif.), Cellfectin™ (Invitrogen; Carlsbad, Calif.), DMRIE-C™ (Invitrogen; Carlsbad, Calif.), FreeStyle™ MAX (Invitrogen; Carlsbad, Calif.), Lipofectamine™ 2000 CD (Invitrogen; Carlsbad, Calif.). Lipofectamine™ (Invitrogen; Carlsbad, Calif.). RNAiMAX (Invitrogen; Carlsbad, Calif.), Oligofectamine™ (Invitrogen; Carlsbad, Calif.), Optifect™ (Invitrogen; Carlsbad, Calif.), X-tremeGENE Q2 Transfection Reagent (Roche; Grenzacherstrasse, Switzerland), DOTAP Liposomal Transfection Reagent (Grenzacherstrasse, Switzerland), DOSPER Liposomal Transfection Reagent (Grenzacherstrasse, Switzerland), or Fugene (Grenzacherstrasse, Switzerland), Transfectam® Reagent (Promega; Madison, Wis.), TransFast™ Transfection Reagent (Promega; Madison, Wis.), Tfxr™-20 Reagent (Promega; Madison. Wis.), Tfx™-50 Reagent (Promega; Madison, Wis.), DreamFect™ (OZ Biosciences; Marseille, France), EcoTransfect (OZ Biosciences; Marseille, France), TransPass$^a$ D1 Transfection Reagent (New England Biolabs; Ipswich, Mass., USA), LyoVec™/LipoGen™ (Invitrogen; San Diego. Calif. USA), PerFectin Transfection Reagent (Genlantis; San Diego, Calif., USA), NeuroPORTER Transfection Reagent (Genlantis; San Diego, Calif., USA), GenePORTER Transfection reagent (Genlantis; San Diego, Calif., USA), GenePORTER 2 Transfection reagent (Genlantis; San Diego, Calif., USA), Cytofectin Transfection Reagent (Genlantis; San Diego, Calif., USA), BaculoPORTER Transfection Reagent (Genlantis; San Diego, Calif., USA), TroganPORTER™ transfection Reagent (Genlantis; San Diego, Calif., USA), RiboFect (Bioline; Taunton, Mass., USA), PlasFect (Bioline; Taunton, Mass., USA), UniFECTOR (B-Bridge International; Mountain View, Calif. USA), SureFECTOR (B-Bridge International; Mountain View, Calif., USA), or HiFect™ (B-Bridge International. Mountain View, Calif., USA), among others.

Other agents can be utilized to enhance the penetration of the administered nucleic acids, including glycols such as ethylene glycol and propylene glycol, pyrrols such as 2-pyrrol, azones, and terpenes such as limonene and menthone.

v. Carriers

Certain compositions of the present invention also incorporate carrier compounds in the formulation. As used herein, "carrier compound" or "carrier" can refer to a nucleic acid, or analog thereof, which is inert (i.e., does not possess biological activity per se) but is recognized as a nucleic acid by in vivo processes that reduce the bioavailability of a nucleic acid having biological activity by, for example, degrading the biologically active nucleic acid or promoting its removal from circulation. The coadministration of a nucleic acid and a carrier compound, typically with an excess of the latter substance, can result in a substantial reduction of the amount of nucleic acid recovered in the liver, kidney or other extracirculatory reservoirs, presumably due to competition between the carrier compound and the nucleic acid for a common receptor. For example, the recovery of a partially phosphorothioate dsRNA in hepatic tissue can be reduced when it is coadministered with polyinosinic acid, dextran sulfate, polycytidic acid or 4-acetamido-4'isothiocyano-stilbene-2,2'-disulfonic acid (Miyao et al., DsRNA Res. Dev., 1995, 5, 115-121; Takakura et al., DsRNA & Nucl. Acid Drug Dev., 1996, 6, 177-183.

vi. Excipients

In contrast to a carrier compound, a "pharmaceutical carrier" or "excipient" is a pharmaceutically acceptable solvent, suspending agent or any other pharmacologically inert vehicle for delivering one or more nucleic acids to an animal. The excipient can be liquid or solid and is selected, with the planned manner of administration in mind, so as to provide for the desired bulk, consistency, etc., when combined with a nucleic acid and the other components of a given pharmaceutical composition. Typical pharmaceutical carriers include, but are not limited to, binding agents (e.g., pregelatinized maize starch, polyvinylpyrrolidone or hydroxypropyl methylcellulose, etc.); fillers (e.g., lactose and other sugars, microcrystalline cellulose, pectin, gelatin, calcium sulfate, ethyl cellulose, polyacrylates or calcium hydrogen phosphate, etc.); lubricants (e.g., magnesium stearate, talc, silica, colloidal silicon dioxide, stearic acid, metallic stearates, hydrogenated vegetable oils, corn starch, polyethylene glycols, sodium benzoate, sodium acetate, etc.); disintegrants (e.g., starch, sodium starch glycolate, etc.); and wetting agents (e.g., sodium lauryl sulphate, etc).

Pharmaceutically acceptable organic or inorganic excipients suitable for non-parenteral administration which do not deleteriously react with nucleic acids can also be used to formulate the compositions of the present invention. Suitable pharmaceutically acceptable carriers include, but are not limited to, water, salt solutions, alcohols, polyethylene glycols, gelatin, lactose, amylose, magnesium stearate, talc, silicic acid, viscous paraffin, hydroxymethylcellulose, polyvinylpyrrolidone and the like.

Formulations for topical administration of nucleic acids can include sterile and non-sterile aqueous solutions, non-aqueous solutions in common solvents such as alcohols, or solutions of the nucleic acids in liquid or solid oil bases. The solutions can also contain buffers, diluents and other suitable additives. Pharmaceutically acceptable organic or inorganic excipients suitable for non-parenteral administration which do not deleteriously react with nucleic acids can be used.

Suitable pharmaceutically acceptable excipients include, but are not limited to, water, salt solutions, alcohol, polyethylene glycols, gelatin, lactose, amylose, magnesium stearate, talc, silicic acid, viscous paraffin, hydroxymethylcellulose, polyvinylpyrrolidone and the like.

vii. Other Components

The compositions of the present invention can additionally contain other adjunct components conventionally found in pharmaceutical compositions, at their art-established usage levels. Thus, for example, the compositions can contain additional, compatible, pharmaceutically-active materials such as, for example, antipruritics, astringents, local anesthetics or anti-inflammatory agents, or can contain additional materials useful in physically formulating various dosage forms of the compositions of the present invention, such as dyes, flavoring agents, preservatives, antioxidants, opacifiers, thickening agents and stabilizers. However, such materials, when added, should not unduly interfere with the biological activities of the components of the compositions of the present invention. The formulations can be sterilized and, if desired, mixed with auxiliary agents, e.g., lubricants, preservatives, stabilizers, wetting agents, emulsifiers, salts for influencing osmotic pressure, buffers, colorings, flavorings and/or aromatic substances and the like which do not deleteriously interact with the nucleic acid(s) of the formulation.

Aqueous suspensions can contain substances which increase the viscosity of the suspension including, for example, sodium carboxymethylcellulose, sorbitol and/or dextran. The suspension can also contain stabilizers.

In some embodiments, pharmaceutical compositions featured in the invention include (a) one or more iRNA compounds and (b) one or more agents which function by a non-RNAi mechanism and which are useful in treating, e.g., PH1.

Testing of Compositions

Toxicity and therapeutic efficacy of such compounds can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. Compounds that exhibit high therapeutic indices are preferred.

The data obtained from cell culture assays and animal studies can be used in formulating a range of dosage for use in humans. The dosage of compositions featured herein in the invention lies generally within a range of circulating concentrations that include the ED50 with little or no toxicity. The dosage can vary within this range depending upon the dosage form employed and the route of administration utilized. For any compound used in the methods featured in the invention, the therapeutically effective dose can be estimated initially from cell culture assays. A dose can be formulated in animal models to achieve a circulating plasma concentration range of the compound or, when appropriate, of the polypeptide product of a target sequence (e.g., achieving a decreased concentration of the polypeptide) that includes the $IC_{50}$ (i.e., the concentration of the test compound which achieves a half-maximal inhibition of symptoms) as determined in cell culture. Such information can be used to more accurately determine useful doses in humans. Levels in plasma can be measured, for example, by high performance liquid chromatography.

In addition to their administration, as discussed above, the iRNAs featured in the invention can be administered in combination with other known agents effective in treatment of pathological processes that are mediated by iron overload and that can be treated by inhibiting HAO1 expression. In any event, the administering physician can adjust the amount and timing of iRNA administration on the basis of results observed using standard measures of efficacy known in the art or described herein.

V. Methods for Inhibiting HAO1 Expression

The present invention provides methods of inhibiting expression of HAO1 (hydroxyacid oxidase 1) in a cell. The methods include contacting a cell with an RNAi agent. e.g., a double stranded RNAi agent, in an amount effective to inhibit expression of the HAO1 in the cell, thereby inhibiting expression of the HAO1 in the cell.

Contacting of a cell with a double stranded RNAi agent may be done in vitro or in vivo. Contacting a cell in vivo with the RNAi agent includes contacting a cell or group of cells within a subject, e.g., a human subject, with the RNAi agent. Combinations of in vitro and in vivo methods of contacting are also possible. Contacting may be direct or indirect, as discussed above. Furthermore, contacting a cell may be accomplished via a targeting ligand, including any ligand described herein or known in the art. In some embodiments, the targeting ligand is a carbohydrate moiety, e.g., a $GalNAc_3$ ligand, or any other ligand that directs the RNAi agent to a site of interest, e.g., the liver of a subject.

The term "inhibiting," as used herein, is used interchangeably with "reducing," "silencing," "downregulating" and other similar terms, and includes any level of inhibition.

The phrase "inhibiting expression of a HAO1" is intended to refer to inhibition of expression of any HAO1 gene (such as, e.g., a mouse HAO1 gene, a rat HAO1 gene, a monkey HAO1 gene, or a human HAO1 gene) as well as variants or mutants of a HAO1 gene. Thus, the HAO1 gene may be a wild-type HAO1 gene, a mutant HAO1 gene, or a transgenic HAO1 gene in the context of a genetically manipulated cell, group of cells, or organism.

"Inhibiting expression of a HAO1 gene" includes any level of inhibition of a HAO1 gene, e.g., at least partial suppression of the expression of a HAO1 gene. The expression of the HAO1 gene may be assessed based on the level, or the change in the level, of any variable associated with HAO1 gene expression, e.g., HAO1 mRNA level. HAO1 protein level. This level may be assessed in an individual cell or in a group of cells, including, for example, a sample derived from a subject.

Inhibition may be assessed by a decrease in an absolute or relative level of one or more variables that are associated with HAO1 expression compared with a control level. The control level may be any type of control level that is utilized in the art, e.g., a pre-dose baseline level, or a level determined from a similar subject, cell, or sample that is untreated or treated with a control (such as, e.g., buffer only control or inactive agent control).

In some embodiments of the methods of the invention, expression of a HAO1 gene is inhibited by at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99%.

Inhibition of the expression of a HAO1 gene may be manifested by a reduction of the amount of mRNA expressed by a first cell or group of cells (such cells may be present, for example, in a sample derived from a subject) in which a HAO1 gene is transcribed and which has or have been treated (e.g., by contacting the cell or cells with an RNAi agent of the invention, or by administering an RNAi agent of the invention to a subject in which the cells are or were present) such that the expression of a HAO1 gene is inhibited, as compared to a second cell or group of cells substantially identical to the first cell or group of cells but which has not or have not been so treated (control cell(s)). In some embodiments, the inhibition is assessed by expressing the level of mRNA in treated cells as a percentage of the level of mRNA in control cells, using the following formula:

$$\frac{(\text{mRNA in control cells}) - (\text{mRNA in treated cells})}{(\text{mRNA in control cells})} \cdot 100\%$$

Alternatively, inhibition of the expression of a HAO1 gene may be assessed in terms of a reduction of a parameter that is functionally linked to HAO1 gene expression, e.g., HAO1 protein expression. HAO1 gene silencing may be determined in any cell expressing HAO1, either constitutively or by genomic engineering, and by any assay known in the art. The liver is the major site of HAO1 expression. Other significant sites of expression include the kidneys and the uterus.

Inhibition of the expression of a HAO1 protein may be manifested by a reduction in the level of the HAO1 protein that is expressed by a cell or group of cells (e.g., the level of protein expressed in a sample derived from a subject). As explained above for the assessment of mRNA suppression, the inhibition of protein expression levels in a treated cell or group of cells may similarly be expressed as a percentage of the level of protein in a control cell or group of cells.

A control cell or group of cells that may be used to assess the inhibition of the expression of a HAO1 gene includes a cell or group of cells that has not yet been contacted with an RNAi agent of the invention. For example, the control cell or group of cells may be derived from an individual subject (e.g., a human or animal subject) prior to treatment of the subject with an RNAi agent.

The level of HAO1 mRNA that is expressed by a cell or group of cells may be determined using any method known in the art for assessing mRNA expression. In one embodiment, the level of expression of HAO1 in a sample is determined by detecting a transcribed polynucleotide, or portion thereof, e.g., mRNA of the HAO1 gene. RNA may be extracted from cells using RNA extraction techniques including, for example, using acid phenol/guanidine isothiocyanate extraction (RNAzol B; Biogenesis), RNeasy RNA preparation kits (Qiagen) or PAXgene (PreAnalytix, Switzerland). Typical assay formats utilizing ribonucleic acid hybridization include nuclear run-on assays, RT-PCR, RNase protection assays (Melton et al., *Nuc. Acids Res.* 12:7035), Northern blotting, in situ hybridization, and microarray analysis.

In one embodiment, the level of expression of HAO1 is determined using a nucleic acid probe. The term "probe", as used herein, refers to any molecule that is capable of selectively binding to a specific HAO1. Probes can be synthesized by one of skill in the art, or derived from appropriate biological preparations. Probes may be specifically designed to be labeled. Examples of molecules that can be utilized as probes include, but are not limited to, RNA, DNA, proteins, antibodies, and organic molecules.

Isolated mRNA can be used in hybridization or amplification assays that include, but are not limited to, Southern or Northern analyses, polymerase chain reaction (PCR) analyses and probe arrays. One method for the determination of mRNA levels involves contacting the isolated mRNA with a nucleic acid molecule (probe) that can hybridize to HAO1 mRNA. In one embodiment, the mRNA is immobilized on a solid surface and contacted with a probe, for example by running the isolated mRNA on an agarose gel and transferring the mRNA from the gel to a membrane, such as nitrocellulose. In an alternative embodiment, the probe(s) are immobilized on a solid surface and the mRNA is contacted with the probe(s), for example, in an Affymetrix gene chip array. A skilled artisan can readily adapt known mRNA detection methods for use in determining the level of HAO1 mRNA.

An alternative method for determining the level of expression of HAO1 in a sample involves the process of nucleic acid amplification and/or reverse transcriptase (to prepare cDNA) of for example mRNA in the sample, e.g., by RT-PCR (the experimental embodiment set forth in Mullis, 1987, U.S. Pat. No. 4,683,202), ligase chain reaction (Barany (1991) *Proc. Natl. Acad. Sci. USA* 88:189-193), self-sustained sequence replication (Guatelli et al. (1990) *Proc. Natl. Acad. Sci. USA* 87:1874-1878), transcriptional amplification system (Kwoh et al. (1989) *Proc. Natl. Acad. Sci. USA* 86:1173-1177), Q-Beta Replicase (Lizardi et al. (1988) *Bio/Technology* 6:1197), rolling circle replication (Lizardi et al., U.S. Pat. No. 5,854,033) or any other nucleic acid amplification method, followed by the detection of the amplified molecules using techniques well known to those of skill in the art. These detection schemes are especially useful for the detection of nucleic acid molecules if such molecules are present in very low numbers. In particular aspects of the invention, the level of expression of HAO1 is determined by quantitative fluorogenic RT-PCR (i.e., the TaqMan™ System).

The expression levels of HAO1 mRNA may be monitored using a membrane blot (such as used in hybridization analysis such as Northern, Southern, dot, and the like), or microwells, sample tubes, gels, beads or fibers (or any solid support comprising bound nucleic acids). See U.S. Pat. Nos. 5,770,722, 5,874,219, 5,744,305, 5,677,195 and 5,445,934, which are incorporated herein by reference. The determination of HAO1 expression level may also comprise using nucleic acid probes in solution.

In some embodiments, the level of mRNA expression is assessed using branched DNA (bDNA) assays or real time PCR (qPCR). The use of these methods is described and exemplified in the Examples presented herein.

The level of HAO1 protein expression may be determined using any method known in the art for the measurement of protein levels. Such methods include, for example, electrophoresis, capillary electrophoresis, high performance liquid chromatography (HPLC), thin layer chromatography (TLC), hyperdiffusion chromatography, fluid or gel precipitin reactions, absorption spectroscopy, a colorimetric assays, spectrophotometric assays, flow cytometry, immunodiffusion (single or double), immunoelectrophoresis, Western blotting, radioimmunoassay (RIA), enzyme-linked immunosorbent assays (ELISAs), immunofluorescent assays, electrochemiluminescence assays, and the like.

The term "sample" as used herein refers to a collection of similar fluids, cells, or tissues isolated from a subject, as well as fluids, cells, or tissues present within a subject. Examples of biological fluids include blood, serum and serosal fluids, plasma, lymph, urine, cerebrospinal fluid, saliva, ocular fluids, and the like. Tissue samples may include samples from tissues, organs or localized regions. For example, samples may be derived from particular organs, parts of organs, or fluids or cells within those organs. In certain embodiments, samples may be derived from the liver (e.g., whole liver or certain segments of liver or certain types of cells in the liver, such as, e.g., hepatocytes). In some embodiments, a "sample derived from a subject" refers to blood or plasma drawn from the subject. In further embodiments, a "sample derived from a subject" refers to liver tissue derived from the subject.

In some embodiments of the methods of the invention, the RNAi agent is administered to a subject such that the RNAi agent is delivered to a specific site within the subject. The inhibition of expression of HAO1 may be assessed using measurements of the level or change in the level of HAO1 mRNA or HAO1 protein in a sample derived from fluid or tissue from the specific site within the subject. In some embodiments, the site is the liver. The site may also be a subsection or subgroup of cells from any one of the aforementioned sites. The site may also include cells that express a particular type of receptor.

VI. Methods for Treating or Preventing a HAO1 Associated Disorder

The present invention also provides methods for treating or preventing diseases and conditions that can be modulated by HAO1 gene expression. For example, the compositions described herein can be used to treat any disorder associated with PH1.

Efficacy of treatment or prevention of disease can be assessed, for example by measuring disease progression, disease remission, symptom severity, reduction in pain, quality of life, dose of a medication required to sustain a treatment effect, level of a disease marker or any other measurable parameter appropriate for a given disease being treated or targeted for prevention. It is well within the ability of one skilled in the art to monitor efficacy of treatment or prevention by measuring any one of such parameters, or any combination of parameters.

A treatment or preventive effect is evident when there is a statistically significant improvement in one or more parameters of disease status, or by a failure to worsen or to develop symptoms where they would otherwise be anticipated. As an example, a favorable change of at least 10% in a measurable parameter of disease, and preferably at least 20%, 30%, 40%, 50% or more can be indicative of effective treatment. Efficacy for a given iRNA drug or formulation of that drug can also be judged using an experimental animal model for the given disease as known in the art. When using an experimental animal model, efficacy of treatment is evidenced when a statistically significant reduction in a marker or symptom is observed.

Alternatively, the efficacy can be measured by a reduction in the severity of disease as determined by one skilled in the art of diagnosis based on a clinically accepted disease severity grading scale.

In some embodiments of the methods of the invention, HAO1 expression is decreased for an extended duration, e.g., at least one week, two weeks, three weeks, or four weeks or longer. For example, in certain instances, expression of the HAO1 gene is suppressed by at least about 5%, 10%, 15%, 20%, 25%, 30%, 35%, 40%, 45%, 50%, 55%, 60%, 65%, 70%, 75%, 800%, 85%, 90%, 95%, 98%, or 100% by administration of an iRNA agent described herein. In some embodiments, the HAO1 gene is suppressed by at least about 60%, 70%, or 80% by administration of the iRNA agent. In some embodiments, the HAO1 gene is suppressed by at least about 85%, 90%, or 95% by administration of the double-stranded oligonucleotide. In another embodiment, the HAO1 gene remains suppressed for 7 days, 10 days, 20 days, 30 days, or more following administration.

Administration

The RNAi agents of the invention may be administered to a subject using any mode of administration known in the art, including, but not limited to subcutaneous, intravenous, intramuscular, intraocular, intrabronchial, intrapleural, intraperitoneal, intraarterial, lymphatic, cerebrospinal, and any combinations thereof. In some embodiments, the agents are administered subcutaneously.

In some embodiments, the administration is via a depot injection. A depot injection may release the RNAi agent in a consistent way over a prolonged time period. Thus, a depot injection may reduce the frequency of dosing needed to obtain a desired effect, e.g., a desired inhibition of HAO1, or a therapeutic or prophylactic effect. A depot injection may also provide more consistent serum concentrations. Depot injections may include subcutaneous injections or intramuscular injections. In some embodiments, the depot injection is a subcutaneous injection.

In some embodiments, the administration is via a pump. The pump may be an external pump or a surgically implanted pump. In certain embodiments, the pump is a subcutaneously implanted osmotic pump. In other embodiments, the pump is an infusion pump. An infusion pump may be used for intravenous, subcutaneous, arterial, or epidural infusions. In some embodiments, the infusion pump is a subcutaneous infusion pump. In other embodiments, the pump is a surgically implanted pump that delivers the RNAi agent to the liver.

Other modes of administration include epidural, intracerebral, intracerebroventricular, nasal administration, intraarterial, intracardiac, intraosseous infusion, intrathecal, and intravitreal, and pulmonary. The mode of administration may be chosen based upon whether local or systemic treatment is desired and based upon the area to be treated. The route and site of administration may be chosen to enhance targeting.

The method includes administering an iRNA agent, e.g., a dose sufficient to depress levels of HAO1 mRNA for at least 5, more preferably 7, 10, 14, 21, 25, 30 or 40 days; and optionally, administering a second single dose of dsRNA, wherein the second single dose is administered at least 5, more preferably 7, 10, 14, 21, 25, 30 or 40 days after the first single dose is administered, thereby inhibiting the expression of the HAO1 gene in a subject.

In one embodiment, doses of iRNA agent of the invention are administered not more than once every four weeks, not more than once every three weeks, not more than once every two weeks, or not more than once every week. In another embodiment, the administrations can be maintained for one, two, three, or six months, or one year or longer. In another embodiment, doses of iRNA agent of the invention are administered once a week for three weeks.

In general, the iRNA agent does not activate the immune system, e.g., it does not increase cytokine levels, such as TNF-alpha or IFN-alpha levels. For example, when measured by an assay, such as an in vitro PBMC assay, such as described herein, the increase in levels of TNF-alpha or IFN-alpha, is less than 300%, 20%, or 10% of control cells treated with a control dsRNA, such as a dsRNA that does not target HAO1.

For example, a subject can be administered a therapeutic amount of an iRNA agent, such as 0.3 mg/kg, 0.5 mg/kg, 1.0 mg/kg, 1.5 mg/kg, 2.0 mg/kg, 2.5 mg/kg, or 3 mg/kg of dsRNA. The iRNA agent can be administered by intravenous infusion over a period of time, such as over a 5 minute, 10 minute, 15 minute, 20 minute, or 25 minute period. The administration is repeated, for example, on a regular basis, such as biweekly (i.e., every two weeks) for one month, two months, three months, four months or longer. After an initial treatment regimen, the treatments can be administered on a less frequent basis. For example, after administration biweekly for three months, administration can be repeated once per month, for six months or a year or longer. Administration of the iRNA agent can reduce HAO1 levels, e.g., in a cell, tissue, blood, urine or other compartment of the patient by at least 10%, at least 15%, at least 20%, at least 25%, at least 30%, at least 40%, at least 50%, at least 60%, at least 70%, at least 80% or at least 90% or more.

Before administration of a full dose of the iRNA agent, patients can be administered a smaller dose, such as a dose resulting in less than 5% infusion reaction, and monitored for adverse effects, such as an allergic reaction, or for elevated lipid levels or blood pressure. In another example, the patient can be monitored for unwanted immunostimulatory effects, such as increased cytokine (e.g., TNF-alpha or INF-alpha) levels.

A patient in need of a HAO1 RNAi agent may be identified by taking a family history. A healthcare provider, such as a doctor, nurse, or family member, can take a family history before prescribing or administering a HAO1 dsRNA. A DNA test may also be performed on the patient to identify a mutation in the AGT1 gene, before a HAO1 RNAi agent is administered to the patient. Diagnosis of PH1 can be confirmed by any test well-known to one of skill in the art.

A treatment or preventive effect is evident when there is a statistically significant improvement in one or more parameters of disease status, or by a failure to worsen or to develop symptoms where they would otherwise be anticipated. As an example, a favorable change of at least 10% in a measurable parameter of disease, and preferably at least 20%, 30%, 40%, 50% or more can be indicative of effective treatment. Efficacy for a given iRNA agent of the invention or formulation of that iRNA agent can also be judged using an experimental animal model for the given disease as known in the art. When using an experimental animal model, efficacy of treatment is evidenced when a statistically significant reduction in a marker or symptom is observed.

The dose of an RNAi agent that is administered to a subject may be tailored to balance the risks and benefits of a particular dose, for example, to achieve a desired level of HAO1 gene suppression (as assessed, e.g., based on HAO1 mRNA suppression, HAO1 protein expression, or a reduction in oxalate levels) or a desired therapeutic or prophylactic effect, while at the same time avoiding undesirable side effects.

In some embodiments, the RNAi agent is administered in two or more doses. If desired to facilitate repeated or frequent infusions, implantation of a delivery device. e.g., a pump, semi-permanent stent (e.g., intravenous, intraperitoneal, intracisternal or intracapsular), or reservoir may be advisable. In some embodiments, the number or amount of subsequent doses is dependent on the achievement of a desired effect, e.g., the suppression of a HAO1 gene, or the achievement of a therapeutic or prophylactic effect. e.g., reducing iron overload. In some embodiments, the RNAi agent is administered according to a schedule. For example, the RNAi agent may be administered once per week, twice per week, three times per week, four times per week, or five times per week. In some embodiments, the schedule involves regularly spaced administrations, e.g., hourly, every four hours, every six hours, every eight hours, every twelve hours, daily, every 2 days, every 3 days, every 4 days, every 5 days, weekly, biweekly, or monthly. In other embodiments, the schedule involves closely spaced administrations followed by a longer period of time during which the agent is not administered. For example, the schedule may involve an initial set of doses that are administered in a relatively short period of time (e.g., about every 6 hours, about every 12 hours, about every 24 hours, about every 48 hours, or about every 72 hours) followed by a longer time period (e.g., about 1 week, about 2 weeks, about 3 weeks, about 4 weeks, about 5 weeks, about 6 weeks, about 7 weeks, or about 8 weeks) during which the RNAi agent is not administered. In one embodiment, the RNAi agent is initially administered hourly and is later administered at a longer interval (e.g., daily, weekly, biweekly, or monthly). In another embodiment, the RNAi agent is initially administered daily and is later administered at a longer interval (e.g., weekly, biweekly, or monthly). In certain embodiments, the longer interval increases over time or is determined based on the achievement of a desired effect. In a specific embodiment, the RNAi agent is administered once daily during a first week, followed by weekly dosing starting on the eighth day of administration. In another specific embodiment, the RNAi agent is administered every other day during a first week followed by weekly dosing starting on the eighth day of administration.

In some embodiments, the RNAi agent is administered in a dosing regimen that includes a "loading phase" of closely spaced administrations that may be followed by a "maintenance phase", in which the RNAi agent is administered at longer spaced intervals. In one embodiment, the loading phase comprises five daily administrations of the RNAi agent during the first week. In another embodiment, the maintenance phase comprises one or two weekly administrations of the RNAi agent. In a further embodiment, the maintenance phase lasts for 5 weeks.

Any of these schedules may optionally be repeated for one or more iterations. The number of iterations may depend on the achievement of a desired effect. e.g., the suppression of a HAO1 gene, and/or the achievement of a therapeutic or prophylactic effect, e.g., reducing oxalate levels or reducing a symptom of PH1.

In another aspect, the invention features, a method of instructing an end user, e.g., a caregiver or a subject, on how to administer an iRNA agent described herein. The method includes, optionally, providing the end user with one or more doses of the iRNA agent, and instructing the end user to administer the iRNA agent on a regimen described herein, thereby instructing the end user.

VII. Kits

The present invention also provides kits for using any of the iRNA agents and/or performing any of the methods of the invention. Such kits include one or more RNAi agent(s) and instructions for use, e.g., instructions for inhibiting expression of a HAO1 in a cell by contacting the cell with the RNAi agent(s) in an amount effective to inhibit expression of the HAO1. The kits may optionally further comprise means for contacting the cell with the RNAi agent (e.g., an injection device), or means for measuring the inhibition of HAO1 (e.g., means for measuring the inhibition of HAO1 mRNA or protein). Such means for measuring the inhibition of HAO1 may comprise a means for obtaining a sample from a subject, such as, e.g., a plasma sample. The kits of the invention may optionally further comprise means for administering the RNAi agent(s) to a subject or means for determining the therapeutically effective or prophylactically effective amount.

VII. Diagnostic Markers for PH1 and Related Conditions

Also described herein are markers and methods for the diagnosis of disease conditions caused by oxalate overproduction, particularly PH1 and related conditions, as well as with agents for the treatment of said conditions.

According to another aspect, the invention relates to a method for the treatment of a PH1 condition in a subject (stone forming diseases, especially PH1). The diagnostic method comprises the steps of: (a) knocking down the HAO1 expression in a subject (b) obtaining a biological serum from said subject; and (b) determining the level of glycolate in said serum. It should be appreciated that elevated level of glycolate in serum, in comparison with negative control, indicates the inhibition of the glycolate oxidase enzyme to prevent oxalate production that is caused the PH1 conditions.

In one embodiment, described herein is a kit for the diagnosis of PH1 condition, said kit including the following: (a) an agent for determining the presence of an analyte of interest in serum, wherein said analyte of interest is one of glycolate; and (b) calibration means. For example, said analyte of interest is glycolate, said agent is an siRNA targeting HAO1.

Unless otherwise defined, all technical and scientific terms used herein have the same meaning as commonly understood by one of ordinary skill in the art to which this invention belongs. Although methods and materials similar or equivalent to those described herein can be used in the practice or testing of the iRNAs and methods featured in the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

EXAMPLES

Materials and Methods

The following materials and methods were used in the Examples. As used herein, "HAO" and "GO" are used interchangeably.

siRNA Synthesis

Single-stranded RNAs were produced by solid phase synthesis on a scale of 1 µmole using an Expedite 8909 synthesizer (Applied Biosystems, Applera Deutschland GmbH, Darm-stadt, Germany) and controlled pore glass (CPG, 500 Å, Proligo Biochemie GmbH, Hamburg. Germany) as solid support. RNA and RNA containing 2'-O-methyl nucleotides were generated by solid phase synthesis employing the corresponding phosphoramidites and 2'-O-methyl phos-phoramidites, respectively (Proligo Biochemie GmbH, Hamburg, Germany). These building blocks were incorporated at selected sites within the sequence of the oligoribonucleotide chain using standard nucleoside phosphoramidite chemistry such as described in Current protocols in nucleic acid chemistry, Beaucage, S. L. et al. (Edrs.), John Wiley & Sons, Inc., New York, N.Y., USA. Phosphorothioate linkages were introduced by replacement of the iodine oxidizer solution with a solution of the Beaucage reagent (Chruachem Ltd, Glasgow, UK) in acetonitrile (1%). Further ancillary reagents were obtained from Mallinckrodt Baker (Griesheim, Germany).

Deprotection and purification of the crude oligoribonucleotides by anion exchange HPLC were carried out according to established procedures. Yields and concentrations were determined by UV absorption of a solution of the respective RNA at a wavelength of 260 nm using a spectral photometer (DU 640B, Beckman Coulter GmbH. UnterschleiBheim, Germany).

Double stranded RNA was generated by mixing an equimolar solution of complementary strands in annealing buffer (20 mM sodium phosphate, pH 6.8; 100 mM sodium chloride), heated in a water bath at 85-90° C. for 3 minutes and cooled to room temperature over a period of 3-4 hours. The annealed RNA solution was stored at −20° C. until use.

In some instances, a duplex (dsRNA) was synthesized more than once. Different batches are labeled with different extensions. For example, AD-62933.1 and AD-62933.2 are different batches of the same duplex.

Cell Culture and Transfections

Primary Cynomolgus monkey hepatocytes (PCH) and primary mouse hepatocytes (PMH) were used. PCHs (Celsis # M003055, lot CBT) or PMH (freshly isolated) were transfected by adding 14.8 µl of Opti-MEM plus 0.2 µl of Lipofectamine RNAiMax per well (Invitrogen, Carlsbad Calif. cat #13778-150) to 5 µl of siRNA duplexes per well into a 96-well plate and incubated at room temperature for 15 minutes, 80 µl of InVitroGRO CP Rat media (InVitro Technologies) containing ~$2 \times 10^4$ PCH or PMH cells were then added to the siRNA mixture. Cells were incubated for 24 hours prior to RNA purification. Single dose experiments were performed at 10 or 20 nM and 0.1 or 0.2 nM final duplex concentration and dose response experiments were done over a range of doses from 10 nM to 36 fM final duplex concentration over 8, 6-fold dilutions.

Total RNA Isolation

Total RNA was isolated using DYNABEADS mRNA Isolation Kit (Invitrogen, part #: 610-12). Cells were harvested and lysed in 150 µl of Lysis/Binding Buffer then mixed for 5 minute at 850 rpm using an Eppendorf Thermomixer (the mixing speed was the same throughout the process). Ten microliters of magnetic beads and 80 µl Lysis/Binding Buffer mixture were added to a round bottom plate and mixed for 1 minute. Magnetic beads were captured using magnetic stand and the supernatant was removed without disturbing the beads. After removing supernatant, the lysed cells were added to the remaining beads and mixed for 5 minutes. After removing supernatant, magnetic beads were washed 2 times with 150 µl Wash Buffer A and mixed for 1 minute. Beads were capture again and supernatant removed. Beads were then washed with 150 µl Wash Buffer B, captured and supernatant was removed. Beads were next washed with 150 µl Elution Buffer, captured and supernatant removed. Beads were allowed to dry for 2 minutes. After drying, 50 µl of Elution Buffer was added and mixed for 5 minutes at 70° C. Beads were captured on magnet for 5 minutes. 40 µl of supernatant was removed and added to another 96 well plate.

cDNA Synthesis

Synthesis of cDNA was performed using the ABI High capacity cDNA reverse transcription kit (Applied Biosystems, Foster City, Calif., Cat #4368813).

A master mix of 2 µl 10× Buffer, 0.8 µl 25× dNTPs, 2 µl Random primers, 1 µl Reverse Transcriptase, 1 µl RNase inhibitor and 3.2 µl of H2O per reaction were added into 10 µl total RNA. cDNA was generated using a Bio-Rad C-1000 or S-1000 thermal cycler (Hercules, Calif.) through the following steps: 25° C. 10 min. 37° C. 120 min, 85° C. 5 sec, 4° C. hold.

Real Time PCR

2 µl of cDNA were added to a master mix containing 0.5 µl of mouse GAPDH (cat #4352339E Life Technologies) or custom designed Cynomolgus monkey GAPDH TaqMan Probes: (F-GCATCCTGGGCTACACTGA, (SEQ ID NO: 13) R-TGGGTGTCGCTGTTGAAGTC (SEQ ID NO: 14), Probe-CCAGGTGGTCTCCTCC (SEQ ID NO: 15)), 0.5 µl human or mouse HAO1 (HS00213909_M1—which is cross reactive with Cynomolgus monkey HOA1, Mm 00439249_m1 for mouse assays, life technologies) and 5 µl Lightcycler 480 probe master mix (Roche Cat #04887301001) per well in a 384 well 50 plates (Roche cat #04887301001). Real time PCR was done in a LightCycler480 Real Time PCR system (Roche) using the ΔΔCt(RQ) assay. Each duplex was tested in two independent transfections and each transfection was assayed in duplicate, unless otherwise noted in the summary tables.

To calculate relative fold change, real time data were analyzed using the ΔΔCt method and normalized to assays performed with cells transfected with 10 nM AD-1955, or mock transfected cells. IC50s were calculated using a 4 parameter fit model using XLFit and normalized to cells transfected with AD-1955 or naive cells.

The sense and antisense sequences of AD-1955 are: SENSE: 5'-cuuAcGcuGAGuAcuucGAdTsdT-3' (SEQ ID NO: 16); and ANTISENSE: 5'-UCGAAGuACUcA-GCGuAAGdTsdT-3' (SEQ ID NO: 17).

TABLE B

Abbreviations of nucleotide monomers used in nucleic acid sequence representation.

| Abbreviation | Nucleotide(s) |
|---|---|
| A | Adenosine-3'-phosphate |
| Ab | beta-L-adenosine-3'-phosphate |
| Af | 2'-fluoroadenosine-3'-phosphate |
| Afs | 2'-fluoroadenosine-3'-phosphorothioate |
| As | adenosine-3'-phosphorothioate |
| C | cytidine-3'-phosphate |
| Cb | beta-L-cytidine-3'-phosphate |
| Cf | 2'-fluorocytidine-3'-phosphate |
| Cfs | 2'-fluorocytidine-3'-phosphorothioate |
| Cs | cytidine-3'-phosphorothioate |
| G | guanosine-3'-phosphate |
| Gb | beta-L-guanosine-3'-phosphate |
| Gbs | beta-L-guanosine-3'-phosphorothioate |
| Gf | 2'-fluoroguanosine-3'-phosphate |
| Gfs | 2'-fluoroguanosine-3'-phosphorothioate |
| Gs | guanosine-3'-phosphorothioate |
| T | 5'-methyluridine-3'-phosphate |
| Tf | 2'-fluoro-5-methyluridine-3'-phosphate |
| Tfs | 2'-fluoro-5-methyluridine-3'-phosphorothioate |
| Ts | 5-methyluridine-3'-phosphorothioate |
| U | Uridine-3'-phosphate |
| Uf | 2'-fluorouridine-3'-phosphate |
| Ufs | 2'-fluorouridine-3'-phosphorothioate |
| Us | uridine-3'-phosphorothioate |
| N | any nucleotide(G, A, C, T or U) |
| a | 2'-O-methyladenosine-3'-phosphate |
| as | 2'-O-methyladenosine-3'-phosphorothioate |
| c | 2'-O-methylcytidine-3'-phosphate |
| cs | 2'-O-methylcytidine-3'-phosphorothioate |
| g | 2'-O-methylguanosine-3'-phosphate |
| gs | 2'-O-methylguanosine-3'-phosphorothioate |
| t | 2'-O-methyl-5-methyluridine-3'-phosphate |
| ts | 2'-O-methyl-5-methyluridine-3'-phosphorothioate |
| u | 2'-O-methyluridine-3'-phosphate |
| us | 2'-O-methyluridine-3'-phosphorothioate |
| dT | 2'-deoxythymidine |
| dTs | 2'-deoxythymidine-3'-phosphorothioate |
| dU | 2'-deoxyuridine |
| s | phosphorothioate linkage |
| L96 | N-[tris(GalNAc-alkyl)-amidodecanoyl)]-4-hydroxyprolinol Hyp-(GalNAc-alkyl)3 |
| (Aeo) | 2'-O-methoxyethyladenosine-3'-phosphate |
| (Aeos) | 2'-O-methoxyethyladenosine-3'-phosphorothioate |
| (Geo) | 2'-O-methoxyethylguanosine-3'-phosphate |
| (Geos) | 2'-O-methoxyethylguanosine-3'-phosphorothioate |
| (Teo) | 2'-O-methoxyethyl-5-methyluridine-3'-phosphate |
| (Teos) | 2'-O-methoxyethyl-5-methyluridine-3'-phosphorothioate |
| (m5Ceo) | 2'-O-methoxyethyl-5-methylcytidine-3'-phosphate |
| (m5Ceos) | 2'-O-methoxyethyl-5-methylcytidine-3'-phosphorothioate |
| (A3m) | 3'-O-methyladenosine-2'-phosphate |
| (A3mx) | 3'-O-methyl-xylofuranosyladenosine-2'-phosphate |
| (G3m) | 3'-O-methylguanosine-2'-phosphate |
| (G3mx) | 3'-O-methyl-xylofuranosylguanosine-2'-phosphate |
| (C3m) | 3'-O-methylcytidine-2'-phosphate |
| (C3mx) | 3'-O-methyl-xylofuranosylcytidine-2'-phosphate |
| (U3m) | 3'-O-methyluridine-2'-phosphate |

TABLE B-continued

Abbreviations of nucleotide monomers used in nucleic acid sequence representation.

| Abbreviation | Nucleotide(s) |
|---|---|
| (U3mx) | 3'-O-methylxylouridine-2'-phosphate |
| (Chd) | 2'-O-hexadecyl-cytidine-3'-phosphate |
| (pshe) | Hydroxyethylphosphorothioate |
| (Uhd) | 2'-O-hexadecyl-uridine-3'-phosphate |
| (Tgn) | Thymidine-glycol nucleic acid (GNA) S-Isomer |
| (Cgn) | Cytidine-glycol nucleic acid (GNA) |
| (Chd) | 2'-O-hexadecyl-cytidine-3'-phosphate |
| (Ggn) | 2'-O-hexadecyl-cytidine-3'-phosphate |
| (Agn) | Adenosine-glycol nucleic acid (GNA) |
| P | 5'-phosphate |
| (m5Cam) | 2'-O-(N-methylacetamide)-5-methylcytidine-3'-phosphate |
| (m5Cams) | 2'-O-(N-methylacetamide)-5-methylcytidine-3'-phosphorothioate |
| (Tam) | 2'-O-(N-methylacetamide)thymidine-3'-phosphate |
| (Tams) | 2'-O-(N-methylacetamide)thymidine-3'-phosphorothioate |
| (Aam) | 2'-O-(N-methylacetamide)adenosine-3'-phosphate |
| (Aams) | 2'-O-(N-methylacetamide)adenosine-3'-phosphorothioate |
| (Gam) | 2'-O-(N-methylacetamide)guanosine-3'-phosphate |
| (Gams) | 2'-O-(N-methylacetamide)guanosine-3'-phosphorothioate |
| Y34 | abasic 2'-O-Methyl |
| Y44 | 2-hydroxymethyl-tetrahydrofurane-5-phosphate |

Example 1. Design, Specificity and Efficacy Prediction of siRNA siRNA design was carried out to identify siRNAs targeting human, cynomolgus monkey, mouse, and rat HAO1 transcripts annotated in the NCBI Gene database (http://www.ncbi.nlm.nih.gov/gene/).

Design used the following transcripts from the NCBI RefSeq collection: human (*Homo sapiens*) HAO1 mRNA is NM_017545.2; cynomolgus monkey (*Macaca fascicularis*) HAO1 mRNA is XM_005568381.1; Mouse (*Mus musculus*) HAO1 mRNA is NM_010403.2; Rat (*Rattus norvegicus*) HAO1 mRNA is XM_006235096.1.

Due to high primate/rodent sequence divergence, siRNA duplexes were designed in several separate batches, including but not limited to batches containing duplexes matching human and cyno transcripts only; human, cyno, mouse, and rat transcripts only; and mouse and rat transcripts only. All siRNA duplexes were designed that shared 100% identity with the listed human transcript and other species transcripts considered in each design batch (above).

The specificity of all possible 19mers was predicted from each sequence. Candidate 19mers that lacked repeats longer than 7 nucleotides were then selected. These 1069 candidate human/cyno, 184 human/cyno/mouse/rat, and 579 mouse/rat siRNAs were used in comprehensive searches against the appropriate transcriptomes (defined as the set of NM_ and XM_records within the human, cyno, mouse, or rat NCBI Refseq sets) using an exhaustive "brute-force" algorithm implemented in the python script 'BruteForce.py'. The script next parsed the transcript-oligo alignments to generate a score based on the position and number of mismatches between the siRNA and any potential 'off-target' transcript. The off-target score is weighted to emphasize differences in the 'seed' region of siRNAs, in positions 2-9 from the 5' end of the molecule. Each oligo-transcript pair from the brute-force search was given a mismatch score by summing the individual mismatch scores; mismatches in the position 2-9 were counted as 2.8, mismatches in the cleavage site positions 10-11 were counted as 1.2, and mismatches in region 12-19 counted as 1.0. An additional off-target prediction was carried out by comparing the frequency of heptamers and octomers derived from 3 distinct, seed-derived hexamers of each oligo. The hexamers from positions 2-7 relative to the 5' start were used to create 2 heptamers and one octomer. Heptamer1 was created by adding a 3' A to the hexamer; heptamer2 was created by adding a 5' A to the hexamer; the octomer was created by adding an A to both 5' and 3' ends of the hexamer. The frequency of octomers and heptamers in the human, cyno, mouse, or rat 3'UTRome (defined as the subsequence of the transcriptome from NCBI's Refseq database where the end of the coding region, the 'CDS', is clearly defined) was pre-calculated. The octomer frequency was normalized to the heptamer frequency using the median value from the range of octomer frequencies. A 'mirSeed-Score' was then calculated by calculating the sum of((3× normalized octomer count)+(2× heptamer2 count)+(1× heptamer1 count)).

Both siRNA strands were assigned to a category of specificity according to the calculated scores: a score above 3 qualified as highly specific, equal to 3 as specific and between 2.2 and 2.8 qualified as moderately specific. The siRNAs were sorted by the specificity of the antisense strand. Duplexes from the human/cyno and mouse/rat sets whose antisense oligos lacked GC at the first position, lacked G at both positions 13 and 14, and had 3 or more Us or As in the seed region (characteristics of duplexes with high predicted efficacy) were then selected. Similarly, duplexes from the human/cyno/mouse and human/cyno/mouse/rat sets that had had 3 or more Us or As in the seed region were selected.

Candidate GalNAc-conjugated duplexes, 21 and 23 nucleotides long on the sense and antisense strands respectively, were designed by extending antisense 19mers 4 additional nucleotides in the 3' direction (preserving perfect complementarity with the target transcript). The sense strand was specified as the reverse complement of the first 21 nucleotides of the antisense 23mer. Duplexes were selected that maintained perfect matches to all selected species transcripts across all 23 nucleotides.

Antisense strands that contained C or G at the first 5' position were modified to have a U at the first 5' position, unless doing so would introduce a run of 4 or more contiguous Us (5'→3'), in which case they were modified to have an A at the first 5' position. Sense strands to be paired into duplexes with these "UA swapped" antisense strands were correspondingly modified to preserve complementarity. Examples described below include AD-62989 and AD-62993.

A total of 31 sense and 31 antisense derived human/cyno, 19 sense and 19 antisense derived human/cyno/mouse/rat, and 48 sense and 48 antisense derived mouse/rat 21/23mer oligos were synthesized and formed into GalNAc-conjugated duplexes.

The sequences of the sense and antisense strands of the modified duplexes are shown in Table 1, and the sequences of the sense and antisense strands of the unmodified duplexes are shown in Table 2.

TABLE 1a

HA01 modified sequences

| Duplex Name | Sense strand sequence | SEQ ID NO: | Antisense strand sequence | SEQ ID NO: | Species |
|---|---|---|---|---|---|
| AD-62933 | GfsasAfuGfuGfaAfAfGfuCfaUfcGfaCfaAfL96 | 18 | usUfsgUfcGfaUfgAfcuuUfcAfcAfuUfcsusg | 89 | Hs/Mm |
| AD-62939 | UfsusUfuCfaAfuGfGfGfuGfuCfcUfaGfgAfL96 | 19 | usCfscUfaGfgAfcAfcccAfuUfgAfaAfasgsu | 90 | Hs/Mm |
| AD-62944 | GfsasAfaGfuCfaUfCfGfaCfaAfgAfcAfuUfL9& | 20 | asAfsuGfuCfuUfgUfcgaUfgAfcUfuUfcsasc | 91 | Hs/Mm |
| AD-62949 | UfscsAfuCfgAfcAfAfGfaCfaUfuGfgUfgAfL96 | 21 | usCfsaCfcAfaUfgUfcuuGfuCfgAfuGfascsu | 92 | Hs/Mm |
| AD-62954 | UfsusUfcAfaUfgGfGfUfgUfcCfuAfgGfaAfL96 | 22 | usUfscCfuAfgGfaCfaccCfaUfuGfaAfasasg | 93 | Hs/Mm |
| AD-62959 | AfsasUfgGfgUfgUfCfCfuAfgGfaAfcCfuUfL96 | 23 | asAfsgGfuUfcCfuAfggaCfaCfcCfaUfusgsa | 94 | Hs/Mm |
| AD-62964 | GfsasCfaGfuGfcAfCfAfaUfaUfuUfcFcAfL96 | 24 | usGfsgAfaAfaUfaUfuguGfcAfcUfgUfcsasg | 95 | Hs/Mm |
| AD-62969 | AfscsUfuUfuCfaAfUfGfgGfuGfuCfcUfaAfL96 | 25 | usUfsaGfgAfcAfcCfcauUfgAfaAfaGfuscsa | 96 | Hs/Mm |
| AD-62934 | AfsasGfuCfaUfcGfAfCfaAfgAfcAfuUfgAfL96 | 26 | usCfsaAfuGfuCfuUfgucGfaUfgAfcUfsususc | 97 | Hs/Mm |
| AD-62940 | AfsusCfgAfcAfaGfAfCfaUfuGfgUfgAfgAfL96 | 27 | usCfsuCfaCfcAfaUfgucUfuGfuCfgAfusgsa | 98 | Hs/Mm |
| AD-62945 | GfsgsGfaGfaAfaGfGfUfgUfuCfaAfgAfuAfL96 | 28 | usAfsuCfuUfgAfaCfaccUfuUfcUfcCfcscsc | 99 | Hs/Mm |
| AD-62950 | CfsusUfuUfcAfaUfGfGfgUfgUfcCfuAfgAfL96 | 29 | usCfsuAfgGfaCfaCfccaUfuGfaAfaAfgsusc | 100 | Hs/Mm |
| AD-62955 | UfscsAfaUfgGfgUfGfUfcCfuAfgGfaAfcAfL96 | 30 | usGfsuUfcCfuAfgGfacaCfcCfaUfuGfasasa | 101 | Hs/Mm |
| AD-62960 | UfsusGfaCfuUfuUfCfAfaUfgGfgUfgUfcAfL96 | 31 | usGfsaCfaCfcCfaUFugaAFaAfgUfcAfasasa | 102 | Hs/Mm |
| AD-62965 | AfsasAfgUfcAfuCfGfAfcAfaGfaCfaUfuAfL96 | 32 | usAfsaUfgUfcUfuGfucgAfuGfaCfuUfuscsa | 103 | Hs/Mm |
| AD-62970 | CfsasGfgGfgGfaGfAfAfaGfgUfgUfuCfaAfL96 | 33 | usUfsgAfaCfaCfcUfuucUfcCfcCfcUfgsgsa | 104 | Hs/Mm |
| AD-62935 | CfsasUfuGfgUfgAfGfGfgAfaAfaUfcCfuUfL96 | 34 | asAfsgGfaUfuUfuUfccuCfaCfcAfaUfgsusc | 105 | Hs/Mm |
| AD-62941 | AfscsAfuUfgGfuGfAfGfgAfaAfaUfcCfuUfL96 | 35 | asGfsgAfuUfuUfuCfcucAfcCfaAfuGfuscsu | 106 | Hs/Mm |
| AD-62946 | AfsgsGfgGfgAfgAfAfAfgGfuGfuUfcAfaAfL96 | 36 | usUfsuGfaAfcAfcCfuuuCfuCfcCfcCfusgsg | 107 | Hs/Mm |

TABLE 1a-continued

HAO1 modified sequences

| Duplex Name | Sense strand sequence | SEQ ID NO: | Antisense strand sequence | SEQ ID NO: | Species |
|---|---|---|---|---|---|
| AD-62951 | AfsusGfgUfgGfuAfAfUfuUfgUfgAfuUfuUfL96 | 37 | asAfsaAfuCfaCfaAfauuAfcCfaCfcAfuscsc | 108 | Ms |
| AD-62956 | GfsasCfuUfgCfaUfCfCfuGfgAfaAfuAfuAfL96 | 38 | usAfsuAfuUfuCfcAfggaUfgCfaAfgUfcscsa | 109 | Hs |
| AD-62961 | GfsgsAfaGfgGfaAfGfGfuAfgAfaGfuCfuUfL96 | 39 | asAfsgAfcUfuCfuAfccuUfcCfcUfuCfcsasc | 110 | Hs |
| AD-62966 | UfsgsUfcUfuCfuGfUfUfuAfgAfuUfuCfcUfL96 | 40 | asGfsgAfaAfuCfuAfaacAfgAfaGfaCfasgsg | 111 | Hs |
| AD-62971 | CfsusUfuGfgCfuGfUfUfuCfcAfaGfaUfcUfL96 | 41 | asGfsaUfcUfuGfgAfaacAfgCFcAfaAfgsgsa | 112 | Hs |
| AD-62936 | AfsasUfgUfgUfuUfGfGfgCfaAfcGfuCfaUfL96 | 42 | asUfsgAfcGfuUfgCfccaAfaCfaCfaUfususu | 113 | Hs |
| AD-62942 | UfsgsUfgAfcUfgUfGfGfaCfaCfcCfcUfuAfL96 | 43 | usAfsaGfgGfgUfgUfccaCfaGfuCfaCfasasa | 114 | Hs |
| AD-62947 | GfsasUfgGfgGfuGfCfCfaGfcUfaCfuAfuUfL96 | 44 | asAfsuAfgUfaGfcUfggcAfcCfcCfaUfcscsa | 115 | Hs |
| AD-62952 | GfsasAfaAfuGfuGfUfUfuGfgGfcAfaCfgUfL96 | 45 | asCfsgUfuGfcCfcAfaacAfcAfuUfuUfcsasa | 116 | Hs |
| AD-62957 | GfsgsCfuGfuUfuCfCfAfaGfaUfcUfgAfcAfL96 | 46 | usGfsuCfaGfaUfFcUfuggAfaAfcAfgCfcsasa | 117 | Hs |
| AD-62962 | UfscsCFaAfcAfaAfAfUfaGfcCfaCfcCfcUfL96 | 47 | asGfsgGfgUfgGfcUfauuUfuGfuUfgGfasasa | 118 | Hs |
| AD-62967 | GfsusCfuUfcUfgUfUfUfaGfaUfuUfcCfuUfL96 | 48 | asAfsgGfaAfaUfcUfaaaCfaGfaAfgAfcsasg | 119 | Hs |
| AD-62972 | UfsgsGfaAfgGfgAfAfGfgUfaGfaAfgUfcUfL96 | 49 | asGfsaCfuUfcUfaCfcuuCfcCfuUfcCfascsa | 120 | Hs |
| AD-62937 | UfscsCfuUfuGfgCfUfGfuUfuCfcAfaGfaUfL96 | 50 | asUfscUfuGfgAfaAfcagCfcAfaAfgGfasusu | 121 | Hs |
| AD-62943 | CfsasUfcUfcUfcAfGfCfuGfgGfaUfgAfuAfL96 | 51 | usAfsuCfaUfcCfcAfgcuGfaGfaGfaUfgsgsg | 122 | Hs |
| AD-62948 | GfsgsGfgUfgCfcAfGfCfuAfcUfaUfuGfaUfL96 | 52 | asUfscAfaUfaGfuAfgcuGfgCfaCfcCfcsasu | 123 | Hs |
| AD-62953 | AfsusGfuGfuUfuGfGfGfcAfaCfgUfcAfuAfL96 | 53 | usAfsuGfaCfgUfuGfcccAfaAfcAfcAfususu | 124 | Hs |
| AD-62958 | CfsusGfuUfuAfgAfUfUfuCfcUfuAfaGfaAfL96 | 54 | usUfscUfuAfaGfgAfaauCfuAfaAfcAfgsasa | 125 | Hs |
| AD-62963 | AfsgsAfaAfgAfaAfUfGfgAfcUfuGfcAfuAfL96 | 55 | usAfsuGfcAfaGfuCfcauUfuCfuUfuCfusasg | 126 | Hs |
| AD-62968 | GfscsAfuCfcUfgGfAfAfaUfaUfaUfuAfaAfL96 | 56 | usUfsuAfaUfaUfaUfuucCfaGfgAfuGfcsasa | 127 | Hs |
| AD-62973 | CfscsUfgUfcAfgAfCfCfaUfgGfgAfaCfuAfL96 | 57 | usAfsgUfuCfcCfaUfgguCfuGfaCfaGfgscsu | 128 | Hs |
| AD-62938 | AfsasAfcAfuGfgUfGfUfgGfaUfgGfgAfuAfL96 | 58 | usAfsuCfcCfaUfcCfacaCfcAFuGfuUfusasa | 129 | Hs |
| AD-62974 | CfsusCfaGfgAfuGfAfAfaAfaUfuUfuGfaAfL96 | 59 | usUfscAfaAfaUfuUfuucAfuCfcUfgAfgsusu | 130 | Ms |
| AD-62978 | CfsasGfcAfuGfuAfUfUfaCfuUfgAfcAfaAfL96 | 60 | usUfsuGfuCfaAfgUfaauAfcAfuGfcUfgsasa | 131 | Hs |
| AD-62982 | UfsasUfgAfaCfaAfCfAfuGfcUfaAfaUfcAfL96 | 61 | usGfsaUfuUfaGfcAfuguUfgUfuCfaUfasasu | 132 | Hs |
| AD-62986 | AfsusAfuAfuCfcAfAfAfuGfuUfuUfaGfgAfL96 | 62 | usCfscUfaAfaAfcAfuuuGfsAfuAfuAfususc | 133 | Hs |
| AD-62990 | CfscsAFgAFuGfgAfAfGfcUfgUfaUfcCfaAFL96 | 63 | usUfsgGfaUfaCfaGfcuuCfcAfuCfuGfgsasa | 134 | Hs |
| AD-62994 | GfsasCfuUfuCfaUfCfCfuGfgAfaAfuAfuAfL96 | 64 | usAfsuAfuUfuCfcAfggaUfgAfaAfgUfcscsa | 135 | Hs |
| AD-62998 | CfscsCfcGfgCfuAfAfUfuUfgUfaUfcAfaUfL96 | 65 | asUfsuGfaUfaCfaAfauuAfgCfcGFgGfgsgsa | 136 | Hs |
| AD-63002 | UfsusAfaAfcAfuGfGfCfuUfgAfaUfgGfgAfL96 | 66 | usCfscCfaUfuCfaAfgccAfuGfuUfuAfascsa | 137 | Hs |
| AD-62975 | AfsasUfgUfgUfuUfAfGfaCfaAfcGfuCfaUfL96 | 67 | asUfsgAfcGfuUfgUfcuaAfaCfaCfaUfususu | 138 | Mm |
| AD-62979 | AfscsUfaAfaGfgAfAfGfaAfuUfcCfgGfuUfL96 | 68 | asAfscCfgGfaAfuUfcuuCfcUfuUfaGfusasu | 139 | Mm |
| AD-62983 | UfsasUfaUfcCfaAfAfUfgUfuUfuAfgGfaUfL96 | 69 | asUfscCfuAfaAfaCfauuUfgGfaUfaUfasusu | 140 | Mm |
| AD-62987 | GfsusGfcGfgAfaAfGfGfcAfcUfgAfuGfuUfL96 | 70 | asAfscAfuCfaGfuGfccuUfuCFcGfcAfcsasc | 141 | Mm |
| AD-62991 | UfsasAfaAfcAfgUfGfGfuUfcUfuAfaAfuUfL96 | 71 | asAfsuUfuAfaGfaAfccaCfuGfuUfuUfasasa | 142 | Mm |
| AD-62995 | AfsusGfaAfaAfaUfUfUfuGfaAfaCfcAfgUfL96 | 72 | asCfsuGfgUfuUfcAfaaaUfuUfuUfcAfuscsc | 143 | Mm |
| AD-62999 | AfsasCfaAfaAfuAfGfCfaAfuCfcCfuUfuUfL96 | 73 | asAfsaAfgGfgAfuUfgcuAfuUfuUfgUfusgsg | 144 | Mm |

TABLE 1a-continued

HAO1 modified sequences

| Duplex Name | Sense strand sequence | SEQ ID NO: | Antisense strand sequence | SEQ ID NO: | Species |
|---|---|---|---|---|---|
| AD-63003 | CfsusGfaAfaCfaGfAfUfcUfgUfcGfaCFuUfL96 | 74 | asAfsgUfcGfaCfaGfaucUfgUfuUfcAfgscsa | 145 | Mm |
| AD-62976 | UfsusGfuUfgCfaAfAfGfgGfcAfuUfuUfgAfL96 | 75 | usCfsaAfaAfuGfcCfcuuUfgCfaAfcAfasusu | 146 | Mm |
| AD-62980 | CfsusCfaUfuGfuUfUfAfuUfaAfcCfuGfuAfL96 | 76 | usAfscAfgGfuUfaAfuaaAfcAfaUfgAfgsasu | 147 | Mm |
| AD-62984 | CfsasAfcAfaAfaUfAfGfcAfaUfcCfcUfuUfL96 | 77 | asAfsaGfgGfaUfuGfcuaUfuUfuGfuUfgsgsa | 148 | Mm |
| AD-62992 | CfsasUfuGfuUfuAfUfUfaAfcCfuGfuAfuUfL96 | 78 | asAfsuAfcAfgGfuUfaauAfaAfcAfaUfgsasg | 149 | Mm |
| AD-62996 | UfsasUfcAfgCfuGfGfGfaAfgAfuAfuCfaAfL96 | 79 | usUfsgAfuAfuCfuUfcccAfgCfuGfaUfasgsa | 150 | Mm |
| AD-63000 | UfsgsUfcCfuAfgGfAfAfcCfuUfuUfaGfaAfL96 | 80 | usUfscUfaAfaAfgGfuucCfuAfgGfaCfascsc | 151 | Mm |
| AD-63004 | UfscsCfaAfcAfaAfAfUfaGfcAfaUfcCfcUfL96 | 81 | asGfsgGfaUfuGfcUfauuUfuGfuUfgGfasasa | 152 | Mm |
| AD-62977 | GfsgsUfgUfgCfgGfAfAfaGfgCfaCfuGfaUfL96 | 82 | asUfscAFgUfgCfcUfuucCfgCfaCfaCfcscsc | 153 | Mm |
| AD-62981 | UfsusGfaAiaCfcAfGfUfaCfuUfuAfuCfaUfL96 | 83 | asUfsgAfuAfaAfgUfacuGfgUfuUfcAfasasa | 154 | Mm |
| AD-62985 | UfsasCfuUfcCfaAfAfGfuCfuAfuAfuAfL96 | 84 | usAfsuAfuAfuAfgAfcuuUfgGfaAfgUfascsu | 155 | Mm |
| AD-62989 | UfscsCfuAfgGfaAfCfCfuUfuUfaGfaAfaUfL96 | 85 | asUfsuUfcUfaAfaAfgguUfcCfuAfgGfascsa | 156 | Mm |
| AD-62993 | CfsusCfcUfgAfgGfAfAfaAfuUfuUfgGfaAfL96 | 86 | usUfscCfaAfaAFuUfuucCfuCfaGfgAfgsasa | 157 | Mm |
| AD-62997 | GFscsUfcCfgGfaAfUfGfuUfgCfuGfaAfaUfL96 | 87 | asUfsuUfcAfgCfaAfcauUfcCfgGfaGfcsasu | 158 | Mm |
| AD-63001 | GfsusGfuUfuGfuGfGfGfgAfgAfcCfaAfuAfL96 | 88 | usAfsuUfgGfuCfuCfcccAfcAfaAfcAfcsasg | 159 | Mm |

TABLE 1b

Additional HAO1 modified sequences.

| Duplex Name | Sense strand sequence | SEQ ID NO: | Antisense strand sequence | SEQ ID NO: | Species |
|---|---|---|---|---|---|
| AD-62933.2 | GfsasAfuGfuGfaAfAfGfuCfaUfcGfaCfaAfL96 | 18 | usUfsgUfcGfaUfgAfcuuUfcAfcAfuUfcsusg | 89 | Hs/Mm |
| AD-62939.2 | UfsusUfuCfaAfuGfGfGfuGfuCfcUfaGfgAfL96 | 19 | usCfscUfaGfgAfcAfcccAfuUfgAfaAfasgsu | 90 | Hs/Mm |
| AD-62944.2 | GfsasAfaGfuCfaUfCfGfaCfaAfgAfcAfuUfL96 | 20 | asAfsuGfuCfuUfgUfcgaUfgAfcUfuUfcsasc | 91 | Hs/Mm |
| AD-62949.2 | UfscsAfuCfgAfcAfAfGfaCfaUfuGfgUfgAfL96 | 21 | usCfsaCfcAfaUfgUfcuuGfuCfgAfuGfascsu | 92 | Hs/Mm |
| AD-62954.2 | UfsusUfcAfaUfgGfGfUfgUfcCfuAfgGfaAfL96 | 22 | usUfscCfuAfgGfaCfaccCfaUfuGfaAfasasg | 93 | Hs/Mm |
| AD-62959.2 | AfsasUfgGfgUfgUfCfCfuAfgGfaAfcCfuUfL96 | 23 | asAfsgGfuUfcCfuAfggaCfaCfcCfaUfusgsa | 94 | Hs/Mm |
| AD-62964.2 | GfsasCfaGfuGfcAfCfAfaUfaUfuUfcCfcAfL96 | 24 | usGfsgGfaAfaUfaUfuguGfcAfcUfgUfcsasg | 95 | Hs/Mm |
| AD-62969.2 | AfscsUfuUfuCfaAfUfGfgGfuGfuCfcUfaAfL96 | 25 | usUfsaGfgAfcAfcCfcauUfgAfaAfaGfuscsa | 96 | Hs/Mm |
| AD-62934.2 | AfsasGfuCfaUfcGfAfCfaAfgAfcAfuUfgAfL96 | 26 | usCfsaAfuGfuCfuUfgucGfaUfgAfcUfususc | 97 | Hs/Mm |
| AD-62940.2 | AfsusCfgAfcAfaGfAfCfaUfuGfgUfgAfgAfL96 | 27 | usCfsuCfaCfcAfaUfgucUfuGfuCfgAfusgsa | 98 | Hs/Mm |
| AD-62945.2 | GfsgsGfaGfaAfaGfGfUfgUfuCfaAfgAfuAfL96 | 28 | usAfsuCfuUfgAfaCfaccUfuUfcUfcCfcscsc | 99 | Hs/Mm |
| AD-62950.2 | CfsusUfuUfcAfaUfGfGfgUfgUfcCfuAfgAfL96 | 29 | usCfsuAfgGfaCfaCfccaUfuGfaAfaAfgsusc | 100 | Hs/Mm |
| AD-62955.2 | UfscsAfaUfgGfgUfGfUfcCfuAfgGfaAfcAfL96 | 30 | usGfsuUfcCfuAfgGfacaCfcCfaUfuGfasasa | 101 | Hs/Mm |
| AD-62960.2 | UfsusGfaCfuUfuUfCfAfaUfgGfgUfgUfcAfL96 | 31 | usGfsaCfaCfcCfaUfugaAfaAfgUfcAfasasa | 102 | Hs/Mm |
| AD-62965.2 | AfsasAfgUfcAfuCfGfAfcAfaGfaCfaUfuAfL96 | 32 | usAfsaUfgUfcUfuGfucgAfuGfaCfuUfuscsa | 103 | Hs/Mm |
| AD-62970.2 | CfsasGfgGfgGfaGfAfAfaGfgUfgUfuCfaAfL96 | 33 | usUfsgAfaCfaCfcUfuucUfcCfcCfcUfgsgsa | 104 | Hs/Mm |
| AD-62935.2 | CfsasUfuGfgUfgAfGfGfaAfaAfuCfuUfL96 | 34 | asAfsgGfaUfuUfuUfccuCfaCfcAfaUfgsusc | 105 | Hs/Mm |

TABLE 1b-continued

Additional HAO1 modified sequences.

| Duplex Name | Sense strand sequence | SEQ ID NO: | Antisense strand sequence | SEQ ID NO: | Species |
|---|---|---|---|---|---|
| AD-62941.2 | AfscsAfuUfgGfuGfAfGfgAfaAfaAfuCfcUfL96 | 35 | asGfsgAfuUfuUfuCfcucAfcCfaAfuGfuscsu | 106 | Hs/Mm |
| AD-62946.2 | AfsgsGfgGfgAfgAfAfAfgGfuGfuUfcAfaAfL96 | 36 | usUfsuGfaAfcAfcCfuuuCfuCfcCfcCfusgsg | 107 | Hs/Mm |
| AD-62951.2 | AfsusGfgUfgGfuAfAfUfuUfgUfgAfuUfuUfL96 | 37 | asAfsaAfuCfaCfaAfauuAfcCfaCfcAfuscsc | 108 | Hs |
| AD-62956.2 | GfsasCfuUfgCfaUfCfCfuGfgAfaAfuAfuAfL96 | 38 | usAfsuAfuUfuCfcAfggaUfgCfaAfgUfcscsa | 109 | Hs |
| AD-62961.2 | GfsgsAfaGfgGfaAfGfGfuAfgAfaGfuCfuUfL96 | 39 | asAfsgAfcUfuCfuAfccuUfcCfcUfuCfcsasc | 110 | Hs |
| AD-62966.2 | UfsgsUfcUfuCfuGfUfUfuAfgAfuUfuCfcUfL96 | 40 | asGfsgAfaUfcUfaAfacAfgAfaGfaCfasgsg | 111 | Hs |
| AD-62971.2 | CfsusUfuGfgCfuGfUfUfuCfcAfaGfaUfcUfL96 | 41 | asGfsaUfcUfuGfgAfaacAfgCfcAfaAfgsgsa | 112 | Hs |
| AD-62936.2 | AfsasUfgUfgUfuUfgGfgCfaAfcGfuCfaUfL96 | 42 | asUfsgAfcGfuUfgCfccaAfaCfaCfaUfususu | 113 | Hs |
| AD-62942.2 | UfsgsUfgAfcUfgUfGfGfaCfaCfcCfcUfaAfL96 | 43 | usAfsaGfgGfgUfgUfccaCfaGfuCfaCfasasa | 114 | Hs |
| AD-62947.2 | GfsasUfgGfgGfuGfCfCfaGfcUfaCfuAfuUfL96 | 44 | asAfsuAfgUfaGfcUfggcAfcCfcCfaUfcscsa | 115 | Hs |
| AD-62952.2 | GfsasAfaAfuGfuGfUfUfuGfgGfcAfaCfgUfL96 | 45 | asCfsgUfuGfcCfcAfaacAfcAfuUfuUfcsasa | 116 | Hs |
| AD-62957.2 | GfsgsCfuGfuUfuCfCfAfaGfaUfcUfgAfcAfL96 | 46 | usGfsuCfaGfaUfcUfuggAfaAfcAfgCfcsasa | 117 | Hs |
| AD-62962.2 | UfscsCfaAfcAfaAfAfUfaGfcCfaCfcCfcUfL96 | 47 | asGfsgGfgUfgGfcUfauuUfuGfuUfgGfasasa | 118 | Hs |
| AD-62967.2 | GfsusCfuUfcUfgUfUfUfaGfaUfuUfcCfuUfL96 | 48 | asAfsgGfaAfaUfcUfaaaCfaGfaAfgAfcsasg | 119 | Hs |
| AD-62972.2 | UfsgsGfaAfgGfgAfAfGfgUfaGfaAfgUfcUfL96 | 49 | asGfsaCfuUfcUfaCfcuuCfcCfuUfcCfascsa | 120 | Hs |
| AD-62937.2 | UfscsCfuUfuGfgCfUfGfuUfuCfcAfaGfaUfL96 | 50 | asUfscUfuGfaAfaAfcagCfcAfaAfgGfasusu | 121 | Hs |
| AD-62943.2 | CfsasUfcUfcUfcAfGfCfuGfgGfaUfgAfuAfL96 | 51 | usAfsuCfaUfcCfcAfgcuGfaGfaGfaUfgsgsg | 122 | Hs |
| AD-62948.2 | GfsgsGfgUfgCfaGfCffuAfcUfaUfgUfaAfL96 | 52 | asUfscAfaUfaGfuAfgcuGfcGfcCfcCfcsasu | 123 | Hs |
| AD-62953.2 | AfsusGfuGfuUfuGfGfGfcAfaCfgUfcAfuAfL96 | 53 | usAfsuGfaCfgUfuGfcccAfaAfcAfcAfususu | 124 | Hs |
| AD-62958.2 | CfsusGfuUfuAfgAfUfUfuCfcUfuAfgAfaAfL96 | 54 | usUfscUfuAfaGfgAfaauCfuAfaAfcAfgsasa | 125 | Hs |
| AD-62963.2 | AfsgsAfaAfgAfaAfUfGfgAfgCfuUfgCfaUfL96 | 55 | usAfsuGfcAfaGfcUfcauUfcUfuUfcUfusasg | 126 | Hs |
| AD-62968.2 | GfscsAfuCfcUfgGfAfAfaUfaUfaUfaAfaAfL96 | 56 | usUfsuAfuAfuAfuUfuucCfaGfaUfgCfcsasa | 127 | Hs |
| AD-62973.2 | CfscsUfgUfcAfgAfCfCfaUfgGfgAfaCfuAfL96 | 57 | usAfsgUfuCfcCfaUfgguCfuGfaCfaGfgscsu | 128 | Hs |
| AD-62938.2 | AfsasAfcAfuGfuUfGfUfgGfaUfgGfgAfuAfL96 | 58 | usAfsuCfcCfaUfcCfacaCffcAfuGfuUfusasa | 129 | Hs |
| AD-62974.2 | CfsusCfaGfgAfuGfAfAfaAfaUfuUfgAfaAfL96 | 59 | usUfscAfaAfaUfuUfuucAfuCfcUfgAfgsusu | 130 | Hs |
| AD-62978.2 | CfsasGfcAfuGfuAfUfUfaCfuGfaCfaAfaAfL96 | 60 | usUfsuGfuCfaAfgUfaauAfcAfuGfcUfgsasa | 131 | Hs |
| AD-62982.2 | UfsasUfgAfaCfaAfCfAfuGfcUfaAfaUfcAfL96 | 61 | usGfsaUfuUfaGfcAfuguUfgUfuCfaUfasasu | 132 | Hs |
| AD-62986.2 | AfsusAfuAfuCfAfAfAfuGfuUfuAfgAfaAfL96 | 62 | usCfscUfaAfaAfcAfuuuGfgAfuAfuAfususc | 133 | Hs |
| AD-62990.2 | CfscsAfgAfuGfaAfAfGfcUfgUfaUfcCfaAfL96 | 63 | usUfsgGfaUfaCfaGfcuuCfcAfuCfuGfgsasa | 134 | Hs |
| AD-62994.2 | GfsasCfuUfcUfaUfCfCfuGfgAfaAfuAfaAfL96 | 64 | usAfsuAfuUfuCfcAfggaUfgAfaAfgUfcscsa | 135 | Hs |
| AD-62998.2 | CfscsCfcGfgCfuAfAfUfuUfgUfaUfcAfaAfL96 | 65 | asUfsuGfaUfaCfaAfauuAfgCfcGfgGfgsgsa | 136 | Hs |
| AD-63002.2 | UfsusAfaAfcAfuGfGfCfuUfgAfaUfgGfaAfL96 | 66 | usCfscCfaUfuCfaAfgccAfuGfuUfuAfascsa | 137 | Hs |
| AD-62975.2 | AfsasUfgUfgUfuUfAfGfaCfaAfcGfuCfaUfL96 | 67 | asUfsgAfcGfuUfgUfcuaAfaCfaCfaUfususu | 138 | Mm |
| AD-62979.2 | AfscsUfaAfaGfgAfAfAfGfaAfuUfcCfgGfuUfL96 | 68 | asAfscCfsgGfaAfuUfcuuCfuUfuAfGfusasu | 139 | Mm |
| AD-62983.2 | UfsasUfaUfcCfaAfAfUfgUfuUfuAfgGfaAfL96 | 69 | asUfscCfuAfaAfaCfauuUfgGfaUfaUfasusu | 140 | Mm |
| AD-62987.2 | GfsusGfcGfgAfaAfGfGfcAfcUfgAfuGfuUfL96 | 70 | asAfscAfuCfaGfuGfccuUfcCfcGfcAfcsasc | 141 | Mm |
| AD-62991.2 | UfsasAfaAfcAfgUfGfGfuUfcUfuAfaAfuUfL96 | 71 | asAfsuUfuAfaGfaAfccaCfuGfuUfuUfasasa | 142 | Mm |

TABLE 1b-continued

Additional HA01 modified sequences.

| Duplex Name | Sense strand sequence | SEQ ID NO: | Ant

TABLE 1b-continued

Additional HAO1 modified sequences.

| Duplex Name | Sense strand sequence | SEQ ID NO: | Antisense strand sequence | SEQ ID NO: | Species |
|---|---|---|---|---|---|
| AD-65654.1 | gsasaugugaaagucau(Cgn)gacaaL96 | 180 | usUfsgUfcGfaUfgAfcuuUfcAfcAfuUfcsusg | 297 | |
| AD-65659.1 | gsasaugdTgaaagucau(Cgn)gacaaL96 | 181 | usUfsgUfcGfaUfgAfcuuUfcAfcAfuUfcsusg | 298 | |
| AD-65627.1 | gsasaudGugaaadGucau(Cgn)gacaaL96 | 182 | usUfsgUfcGfaUfgAfcuuUfcAfcAfuUfcsusg | 299 | |
| AD-65633.1 | gsasaugdTgaaadGucau(Cgn)gacaaL96 | 183 | usUfsgUfcGfaUfgAfcuuUfcAfcAfuUfcsusg | 300 | |
| AD-65639.1 | gsasaugudGaaadGucau(Cgn)gacaaL96 | 184 | usUfsgUfcGfaUfgAfcuuUfcAfcAfuUfcusg | 301 | |
| AD-65645.1 | gsasaugugaaadGucaucdGacaaL96 | 185 | usUfsgUfcGfaUfgAfcuuUfcAfcAfuUfcsusg | 302 | |
| AD-65650.1 | gsasaugugaaadGucaucdTacaaL96 | 186 | usUfsgUfcGfaUfgAfcuuUfcAfcAfuUfcsusg | 303 | |
| AD-65655.1 | gsasaugugaaadGucaucY34acaaL96 | 187 | usUfsgUfcGfaUfgAfcuuUfcAfcAfuUfcsusg | 304 | |
| AD-65660.1 | gsasaugugaaadGucadTcdTacaaL96 | 188 | usUfsgUfcGfaUfgAfcuuUfcAfcAfuUfcsusg | 305 | |
| AD-65665.1 | gsasaugugaaadGucaucdGadCaaL96 | 189 | usUfsgUfcGfaUfgAfcuuUfcAfcAfuUfcsusg | 306 | |
| AD-65628.1 | gsasaugugaaadGucaucdTadCaaL96 | 190 | usUfsgUfcGfaUfgAfcuuUfcAfcAfuUfcsusg | 307 | |
| AD-65634.1 | gsasaugugaaadGucaucY34adCaaL96 | 191 | usUfsgUfcGfaUfgAfcuuUfcAfcAfuUfcsusg | 308 | |
| AD-65646.1 | GfsasAfuGfuGfaAfAfGfuCfaUfcGfaCfaAfL96 | 192 | usdTsgucgaugdAcuudTcacauucsusg | 309 | |
| AD-65656.1 | GfsasAfuGfuGfaAfAfGfuCfaUfcGfaCfaAfL96 | 193 | usUsgucgaugacuudTcacauucsusg | 310 | |
| AD-65661.1 | GfsasAfuGfuGfaAfAfGfuCfaUfcGfaCfaAfL96 | 194 | usdTsgucdGaugacuudTcacauucsusg | 311 | |
| AD-65666.1 | GfsasAfuGfuGfaAfAfGfuCfaUfcGfaCfaAfL96 | 195 | usUsgucdGaugacuudTcacauucsusg | 312 | |
| AD-65629.1 | GfsasAfuGfuGfaAfAfGfuCfaUfcGfaCfaAfL96 | 196 | usdTsgucgaugacuudTcdAcauucsusg | 313 | |
| AD-65635.1 | GfsasAfuGfuGfaAfAfGfuCfaUfcGfaCfaAfL96 | 197 | usdTsgucdGaugacuudTcdAcauucsusg | 314 | |
| AD-65641.1 | gsasaugugaaadGucau(Cgn)gacaaL96 | 198 | usdTsgucgaugdAcuudTcacauucsusg | 315 | |
| AD-62994.1 | GfsasCfuUfuCfaUfCfCfuGfgAfaAfuAfuAfL96 | 199 | usAfsuAfuUfuCfcAfggaUfgAfaAfgUfcscsa | 316 | |
| AD-65595.1 | gsascuuuCfaUfCfCfuggaAfauauaL96 | 200 | usAfsuAfuUfuCfcAfggaUfgAfaAfgUfcscsa | 317 | |
| AD-65600.1 | gsascuuuCfaUfCfCfuggaaauauaL96 | 201 | usAfsuAfuUfuCfcAfggaUfgAfaAfgUfcscsa | 318 | |
| AD-65610.1 | gsascuuuCfaucCfuggaaAfuauaL96 | 202 | usAfsuAfuUfuCfcAfggaUfgAfaAfgUfcscsa | 319 | |
| AD-65615.1 | gsascuuucaucCfuggaaAfuauaL96 | 203 | usAfsuAfuUfuCfcAfggaUfgAfaAfgUfcscsa | 320 | |
| AD-65620.1 | gsascuuuCfaucCfuggaaauauaL96 | 204 | usAfsuAfuUfuCfcAfggaUfgAfaAfgUfcscsa | 321 | |
| AD-65584.1 | CfsusUfuCfaUfCfCfuGfgAfaAfuAfuAfL96 | 205 | usAfsuAfuUfuCfcAfggaUfgAfaAfgsusc | 322 | |
| AD-65590.1 | csusuuCfaUfCfCfuggaaauauaL96 | 206 | usAfsuauUfuccaggaUfgAfaagsusc | 323 | |
| AD-65596.1 | GfsasCfuUfuCfaUfCfCfuGfgAfaAfuAfuAfL96 | 207 | usAfsuauUfuCfcAfggaUfgAfaagucscsa | 324 | |
| AD-65601.1 | GfsasCfuUfuCfaUfCfCfuGfgAfaAfuAfuAfL96 | 208 | usAfsuauUfuCfCfaggaUfgAfaagucscsa | 325 | |
| AD-65606.1 | GfsasCfuUfuCfaUfCfCfuGfgAfaAfuAfuAfL96 | 209 | usAfsuauUfuccaggaUfgAfaagucscsa | 326 | |
| AD-65611.1 | GfsasCfuUfuCfaUfCfCfuGfgAfaAfuAfuAfL96 | 210 | usAfsuauUfuccaggaUfgaaagucscsa | 327 | |
| AD-65616.1 | GfsasCfuUfuCfaUfCfCfuGfgAfaAfuAfuAfL96 | 211 | usAfsuauuuccaggaUfgaaagucscsa | 328 | |
| AD-65621.1 | gsascuuuCfaUfCfCfuggaaauauaL96 | 212 | usAfsuauUfuCfcAfggaUfgAfaagucscsa | 329 | |
| AD-65585.1 | gsascuuuCfaUfCfCfuggaaauauaL96 | 213 | usAfsuauUfuCfCfaggaUfgAfaagucscsa | 330 | |
| AD-65591.1 | gsascuuuCfaUfCfCfuggaaausuaL96 | 214 | usAfsuauUfuccaggaUfgAfaagucscsa | 331 | |
| AD-65597.1 | gsascuuuCfauCfCfuggaaauauaL96 | 215 | usAfsuauUfuCfcAfggaUfgAfaagucscsa | 332 | |
| AD-65602.1 | gsascuuuCfauCfCfuggaaauauaL96 | 216 | usAfsuauUfuCfCfa ggaUfgAfaagucscsa | 333 | |

TABLE 1b-continued

Additional HAO1 modified sequences.

| Duplex Name | Sense strand sequence | SEQ ID NO: | Antisense strand sequence | SEQ ID NO: | Species |
|---|---|---|---|---|---|
| AD-65607.1 | gsascuuuCfauCfCfuggaaauauaL96 | 217 | usAfsuauUfuccaggaUfgAfaagucscsa | 334 | |
| AD-65612.1 | gsascuuucauccuggaa(Agn)uauaL96 | 218 | usAfsuAfuUfuCfcAfggaUfgAfaAfgUfcscsa | 335 | |
| AD-65622.1 | gsascuuucaucdCuggaa(Agn)uauaL96 | 219 | usAfsuAfuUfuCfcAfggaUfgAfaAfgUfcscsa | 336 | |
| AD-65586.1 | gsascudTucaucdCuggaa(Agn)uauaL96 | 220 | usAfsuAfuUfuCfcAfggaUfgAfaAfgUfcscsa | 337 | |
| AD-65592.1 | gsascuudTcaucdCuggaa(Agn)uauaL96 | 221 | usAfsuAfuUfuCfcAfggaUfgAfaAfgUfcscsa | 338 | |
| AD-65598.1 | gsascuuudCaucdCuggaa(Agn)uauaL96 | 222 | usAfsuAfuUfuCfcAfggaUfgAfaAfgUfcscsa | 339 | |
| AD-65603.1 | gsascuuucaucdCuggaadAuauaL96 | 223 | usAfsuAfuUfuCfcAfggaUfgAfaAfgUfcscsa | 340 | |
| AD-65608.1 | gsascuuucaucdCuggaadTuauaL96 | 224 | usAfsuAfuUfuCfcAfggaUfgAfaAfgUfcscsa | 341 | |
| AD-65613.1 | gsascuuucaucdCuggaaY34uauaL96 | 225 | usAfsuAfuUfuCfcAfggaUfgAfaAfgUfcscsa | 342 | |
| AD-65618.1 | gsascuuucaucdCuggdAadTuauaL96 | 226 | usAfsuAfuUfuCfcAfggaUfgAfaAfgUfcscsa | 343 | |
| AD-65623.1 | gsascuuucaucdCuggaadTudAuaL96 | 277 | usAfsuAfuUfuCfcAfggaUfgAfaAfgUfcscsa | 344 | |
| AD-65587.1 | gsascuuucaucdCuggaa(Agn)udAuaL96 | 228 | usAfsuAfuUfuCfcAfggaUfgAfaAfgUfcscsa | 345 | |
| AD-65593.1 | gsascuudTcaucdCuggaadAudAuaL96 | 229 | usAfsuAfuUfuCfcAfggaUfgAfaAfgUfcscsa | 346 | |
| AD-65599.1 | GfsasCfuUfuCfaUfCfCfuGfgAfaAfuAfuAfL96 | 230 | usdAsuauuuccdAggadTgaaagucscsa | 347 | |
| AD-65604.1 | GfsasCfuUfuCfaUfCfCfuGfgAfaAfuAfuAfL96 | 231 | usdAsuauuuccaggadTgaaagucscsa | 348 | |
| AD-65609.1 | GfsasCfuUfuCfaUfCfCfuGfgAfaAfuAfuAfL96 | 232 | usAsuauuuccaggadTgaaagucscsa | 349 | |
| AD-65614.1 | GfsasCfuUfuCfaUfCfCfuGfgAfaAfuAfuAfL96 | 233 | usdAsuaudTuccaggadTgaaagucscsa | 350 | |
| AD-65619.1 | GfsasCfuUfuCfaUfCfCfuGfgAfaAfuAfuAfL96 | 234 | usAsuaudTuccaggadTgaaagucscsa | 351 | |
| AD-65624.1 | GfsasCfuUfuCfaUfCfCfuGfgAfaAfuAfuAfL96 | 235 | usdAsuauuuccaggadTgdAaagucscsa | 352 | |
| AD-65588.1 | GfsasCfuUfuCfaUfCfCfuGfgAfaAfuAfuAfL96 | 236 | usdAsuaudTuccaggadTgdAaagucscsa | 353 | |
| AD-65594.1 | gsascuuucaucdCuggaa(Agn)uauaL96 | 237 | usdAsuauuuccdAggadTgaaagucscsa | 354 | |
| AD-68309.1 | asgsaaagGfuGfUfUfcaagaugucaL96 | 238 | usGfsacaUfcUfUfgaacAfcCfuuucuscsc | 355 | |
| AD-68303.1 | csasuccuGfgAfAfAfuauauuaacuL96 | 239 | asGfsuuaAfuAfUfauuuCfcAfggaugsasa | 356 | |
| AD-65626.5 | gsasauguGfaAfAfGfucaucgacaaL96 | 240 | usUfsgucGfaUfGfacuuUfcAfcauucsusg | 357 | |
| AD-68295.1 | asgsugcaCfaAfUfAfuuuucccauaL96 | 241 | usAfsuggGfaAfAfauauUfgUfgcacusgsu | 358 | |
| AD-68273.1 | gsasaaguCfaUfCfGfacaagacauuL96 | 242 | asAfsuguCfuUfGfucgaUfgAfcuuucsasc | 359 | |
| AD-68297.1 | asasugugAfaAfGfUfcaucgacaaaL96 | 243 | usUfsuguCfgAfUfgacuUfuCfacauuscsu | 360 | |
| AD-68287.1 | csusggaaAfuAfUfAfuuaacuguuaL96 | 244 | usAfsacaGfuUfAfauauAfuUfuccagsgsa | 361 | |
| AD-68300.1 | asusuuucCfcAfUfCfuguauuauuuL96 | 245 | asAfsauaAfuAfCfagauGfgGfaaaausasu | 362 | |
| AD-68306.1 | usgsucguUfcUfUfUfuccaacaaaaL96 | 246 | usUfsuugUfuGfGfaaaaGfaAfcgacascsc | 363 | |
| AD-68292.1 | asusccugGfaAfAfUfauauuaacuaL96 | 247 | usAfsguuAfaUfAfuauuUfcCfaggausgsa | 364 | |
| AD-68298.1 | gscsauuuUfgAfGfAfggugaugauaL96 | 248 | usAfsucaUfcAfCfcucuCfaAfaaugcscsc | 365 | |
| AD-68277.1 | csasggggGfaGfAfAfagguguucaaL96 | 249 | usUfsgaaCfaCfCfuuucUfcCfcccugsgsa | 366 | |
| AD-68289.1 | gsgsaaauAfuAfUfUfaacuguuaaaL96 | 250 | usUfsuaaCfaGfUfuaauAfuAfuuuccsasg | 367 | |
| AD-68272.1 | csasuuggUfgAfGfGfaaaaauccuuL96 | 251 | asAfsggaUfuUfUfuccuCfaCfcaaugsusc | 368 | |
| AD-68282.1 | gsgsgagaAfaGfGfUfguucaagauaL96 | 252 | usAfsucuUfgAfAfcaccUfuUfcucccscsc | 369 | |
| AD-68285.1 | gsgscauuUfuGfAfGfaggugaugauL96 | 253 | asUfscauCfaCfCfucucAfaAfaugccscsu | 370 | |

TABLE 1b-continued

Additional HA01 modified sequences.

| Duplex Name | Sense strand sequence | SEQ ID NO: | Antisense strand sequence | SEQ ID NO: | Species |
|---|---|---|---|---|---|
| AD-68290.1 | usascaaaGfgGfUfGfucguucuuuuL96 | 254 | asAfsaagAfaCfGfacacCfcUfuuguasusu | 371 | |
| AD-68296.1 | usgsggauCfuUfGfGfugucgaaucaL96 | 255 | usGfsauuCfgAfCfaccaAfgAfucccasusu | 372 | |
| AD-68288.1 | csusgacaGfuGfCfAfcaauauuuuaL96 | 256 | usAfsaaaUfaUfUfgugcAfcUfgucagsasu | 373 | |
| AD-68299.1 | csasgugcAfcAfAfUfauuuucccauL96 | 257 | asUfsgggAfaAfAfuauuGfuGfcacugsusc | 374 | |
| AD-68275.1 | ascsuuuuCfaAfUfGfggugugccuaaL96 | 258 | usUfsaggAfcAfCfccauUfgAfaaagusesa | 375 | |
| AD-68274.1 | ascsauugGfuGfAfGfgaaaaauccuL96 | 259 | asGfsgauUfuUfUfccucAfcCfaaugusesu | 376 | |
| AD-68294.1 | ususgcuuUfgGfAfCfuuuucaaugaL96 | 260 | usCfsauuGfaAfAfagucAfaAfagcaasusg | 377 | |
| AD-68302.1 | csasuuuuGfaGfAfGfgugaugaugaL96 | 261 | usCfsaucAfuCfAfccucUfcAfaaaugsesc | 378 | |
| AD-68279.1 | ususgacuUfuUfCfAfaugggugucaL96 | 262 | usGfsacaCfcCfAfuugaAfaAfgucaasasa | 379 | |
| AD-68304.1 | csgsacuuCfuGfUfUfuuaggacagaL96 | 263 | usCfsuguCfcUfAfaaacAfgAfagucgsasc | 380 | |
| AD-68286.1 | csuscugaGfuGfGfGfugccagaauaL96 | 264 | usAfsuucUfgGfCfacccAfcUfcagagsesc | 381 | |

TABLE 2a-continued

HA01 unmodified sequences (human and human/mouse)

| Duplex Name | SEQ ID NO: | Sense strand sequence | SEQ ID NO: | Antisense strand sequence | Position in NM_017545.2 |
|---|---|---|---|---|---|
| AD-62940 | 403 | AUCGACAAGACAUUGGUGAGA | 452 | UCUCACCAAUGUCUUGUCGAUGA | 1085-1107_G21A |
| AD-62945 | 404 | GGGAGAAAGGUGUUCAAGAUA | 453 | UAUCUUGAACACCUUUCUCCCCC | 996-1018_G21A |
| AD-62950 | 405 | CUUUUCAAUGGGUGUCCUAGA | 454 | UCUAGGACACCCAUUGAAAAGUC | 1301-1323_G21A |
| AD-62955 | 406 | UCAAUGGGUGUCCUAGGAACA | 455 | UGUUCCUAGGACACCCAUUGAAA | 1305-1327_C21A |
| AD-62960 | 407 | UUGACUUUCAAUGGGUGUCA | 456 | UGACACCCAUUGAAAAGUCAAAA | 1297-1319_C21A |
| AD-62965 | 408 | AAAGUCAUCGACAAGACAUUA | 457 | UAAUGUCUUGUCGAUGACUUUCA | 1079-1101_G21A |
| AD-62970 | 409 | CAGGGGGAGAAAGGUGUUCAA | 458 | UUGAACACCUUUCUCCCCCUGGA | 992-1014 |
| AD-62935 | 410 | CAUUGGUGAGGAAAAAUCCUU | 459 | AAGGAUUUUUCCUCACCAAUGUC | 1095-1117 |
| AD-62941 | 411 | ACAUUGGUGAGGAAAAAUCCU | 460 | AGGAUUUUUCCUCACCAAUGUCU | 1094-1116 |
| AD-62946 | 412 | AGGGGGAGAAAGGUGUUCAAA | 461 | UUUGAACACCUUUCUCCCCCUGG | 993-1015_G21A |
| AD-62974 | 413 | CUCAGGAUGAAAAAUUUUGAA | 462 | UUCAAAAUUUUUCAUCCUGAGUU | 563-585 |
| AD-62978 | 414 | CAGCAUGUAUUACUUGACAAA | 463 | UUUGUCAAGUAAUACAUGCUGAA | 1173-1195 |
| AD-62982 | 415 | UAUGAACAACAUGCUAAAUCA | 464 | UGAUUUAGCAUGUUGUUCAUAAU | 53-75 |
| AD-62986 | 416 | AUAUAUCCAAAUGUUUUAGGA | 465 | UCCUAAAACAUUUGGAUAUAUUC | 1679-1701 |
| AD-62990 | 417 | CCAGAUGGAAGCUGUAUCCAA | 466 | UUGGAUACAGCUUCCAUCUGGAA | 156-178 |
| AD-62994 | 418 | GACUUUCAUCCUGGAAAUAUA | 467 | UAUAUUUCCAGGAUGAAAGUCCA | 1341-1363 |
| AD-62998 | 419 | CCCCGGCUAAUUUGUAUCAAU | 468 | AUUGAUACAAAUUAGCCGGGGGA | 29-51 |
| AD-63002 | 420 | UUAAACAUGGCUUGAAUGGGA | 469 | UCCCAUUCAAGCCAUGUUUAACA | 765-787 |
| AD-62975 | 421 | AAUGUGUUUAGACAACGUCAU | 470 | AUGACGUUGUCUAAACACAUUUU | 1388-1410 |
| AD-62979 | 422 | ACUAAAGGAAGAAUUCCGGUU | 471 | AACCGGAAUUCUUCCUUUAGUAU | 1027-1049 |
| AD-62983 | 423 | UAUAUCCAAAUGUUUUAGGAU | 472 | AUCCUAAAACAUUUGGAUAUAUU | 1680-1702 |
| AD-62987 | 424 | GUGCGGAAAGGCACUGAUGUU | 473 | AACAUCAGUGCCUUUCCGCACAC | 902-924 |
| AD-62991 | 425 | UAAAACAGUGGUUCUUAAAUU | 474 | AAUUUAAGAACCACUGUUUUAAA | 1521-1543 |
| AD-62995 | 426 | AUGAAAAAUUUUGAAACCAGU | 475 | ACUGGUUUCAAAAUUUUUCAUCC | 569-591 |
| AD-62999 | 427 | AACAAAAUAGCAAUCCCUUUU | 476 | AAAAGGGAUUGCUAUUUUGUUGG | 1264-1286 |
| AD-63003 | 428 | CUGAAACAGAUCUGUCGACUU | 477 | AAGUCGACAGAUCUGUUUCAGCA | 195-217 |
| AD-62976 | 429 | UUGUUGCAAAGGGCAUUUUGA | 478 | UCAAAAUGCCCUUUGCAACAAUU | 720-742 |
| AD-62980 | 430 | CUCAUUGUUUAUUAACCUGUA | 479 | UACAGGUUAAUAAACAAUGAGAU | 1483-1505 |
| AD-62984 | 431 | CAACAAAAUAGCAAUCCCUUU | 480 | AAAGGGAUUGCUAUUUUGUUGGA | 1263-1285 |
| AD-62992 | 432 | CAUUGUUUAUUAACCUGUAUU | 481 | AAUACAGGUUAAUAAACAAUGAG | 1485-1507 |
| AD-62996 | 433 | UAUCAGCUGGGAAGAUAUCAA | 482 | UUGAUAUCUUCCCAGCUGAUAGA | 670-692 |
| AD-63000 | 434 | UGUCCUAGGAACCUUUUAGAA | 483 | UUCUAAAAGGUUCCUAGGACACC | 1313-1335 |
| AD-63004 | 435 | UCCAACAAAAUAGCAAUCCCU | 484 | AGGGAUUGCUAUUUUGUUGGAAA | 1261-1283 |
| AD-62977 | 436 | GGUGCGGAAAGGCACUGAU | 485 | AUCAGUGCCUUUCCGCACACCCC | 899-921 |
| AD-62981 | 437 | UUGAAACCAGUACUUUUAUCAU | 486 | AUGAUAAAGUACUGGUUUCAAAA | 579-601 |
| AD-62985 | 438 | UACUUCCAAAGUCUAUAUAUA | 487 | UAUAUAUAGACUUUGGAAGUACU | 75-97_G21A |
| AD-62989 | 439 | UCCUAGGAACCUUUUAGAAAU | 488 | AUUUCUAAAAGGUUCCUAGGACA | 1315-1337_G21U |

TABLE 2a-continued

HAO1 unmodified sequences (human and human/mouse)

| Duplex Name | SEQ ID NO: | Sense strand sequence | SEQ ID NO: | Antisense strand sequence | Position in NM_017545.2 |
|---|---|---|---|---|---|
| AD-62993 | 440 | CUCCUGAGGAAAAUUUUGGAA | 489 | UUCCAAAAUUUUCCUCAGGAGAA | 603-625_G21A |
| AD-62997 | 441 | GCUCCGGAAUGUUGCUGAAAU | 490 | AUUUCAGCAACAUUCCGGAGCAU | 181-203_C21U |
| AD-63001 | 442 | GUGUUUGUGGGGAGACCAAUA | 491 | UAUUGGUCUCCCCACAAACACAG | 953-975_C21A |

TABLE 2b

HAO1 unmodified sequences (mouse)

| Duplex Name | SEQ ID NO: | Sense strand sequence | SEQ ID NO: | Antisense strand sequence | Position in NM_010403.2 |
|---|---|---|---|---|---|
| AD-62951 | 492 | AUGGUGGUAAUUUGUGAUUUU | 514 | AAAAUCACAAAUUACCACCAUCC | 1642-1664 |
| AD-62956 | 493 | GACUUGCAUCCUGGAAAUAUA | 515 | UAUAUUUCCAGGAUGCAAGUCCA | 1338-1360 |
| AD-62961 | 494 | GGAAGGGAAGGUAGAAGUCUU | 516 | AAGACUUCUACCUUCCCUUCCAC | 864-886 |
| AD-62966 | 495 | UGUCUUCUGUUUAGAUUUCCU | 517 | AGGAAAUCUAAACAGAAGACAGG | 1506-1528 |
| AD-62971 | 496 | CUUUGGCUGUUUCCAAGAUCU | 518 | AGAUCUUGGAAACAGCCAAAGGA | 1109-1131 |
| AD-62936 | 497 | AAUGUGUUUGGGCAACGUCAU | 519 | AUGACGUUGCCCAAACACAUUUU | 1385-1407 |
| AD-62942 | 498 | UGUGACUGUGGACACCCCUUA | 520 | UAAGGGGUGUCCACAGUCACAAA | 486-508 |
| AD-62947 | 499 | GAUGGGGUGCCAGCUACUAUU | 521 | AAUAGUAGCUGGCACCCCAUCCA | 814-836 |
| AD-62952 | 500 | GAAAAUGUGUUUGGGCAACGU | 522 | ACGUUGCCCAAACACAUUUUCAA | 1382-1404 |
| AD-62957 | 501 | GGCUGUUUCCAAGAUCUGACA | 523 | UGUCAGAUCUUGGAAACAGCCAA | 1113-1135 |
| AD-62962 | 502 | UCCAACAAAAUAGCCACCCCU | 524 | AGGGGUGGCUAUUUUGUUGGAAA | 1258-1280 |
| AD-62967 | 503 | GUCUUCUGUUUAGAUUUCCUU | 525 | AAGGAAAUCUAAACAGAAGACAG | 1507-1529 |
| AD-62972 | 504 | UGGAAGGGAAGGUAGAAGUCU | 526 | AGACUUCUACCUUCCCUUCCACA | 863-885 |
| AD-62937 | 505 | UCCUUUGGCUGUUUCCAAGAU | 527 | AUCUUGGAAACAGCCAAAGGAUU | 1107-1129 |
| AD-62943 | 506 | CAUCUCUCAGCUGGGAUGAUA | 528 | UAUCAUCCCAGCUGAGAGAUGGG | 662-684 |
| AD-62948 | 507 | GGGGUGCCAGCUACUAUUGAU | 529 | AUCAAUAGUAGCUGGCACCCCAU | 817-839 |
| AD-62953 | 508 | AUGUGUUUGGGCAACGUCAUA | 530 | UAUGACGUUGCCCAAACACAUUU | 1386-1408_C21A |
| AD-62958 | 509 | CUGUUUAGAUUUCCUUAAGAA | 531 | UUCUUAAGGAAAUCUAAACAGAA | 1512-1534_C21A |
| AD-62963 | 510 | AGAAAGAAAUGGACUUGCAUA | 532 | UAUGCAAGUCCAUUUCUUUCUAG | 1327-1349_C21A |
| AD-62968 | 511 | GCAUCCUGGAAAUAUAUUAAA | 533 | UUUAAUAUAUUUCCAGGAUGCAA | 1343-1365_C21A |
| AD-62973 | 512 | CCUGUCAGACCAUGGGAACUA | 534 | UAGUUCCCAUGGUCUGACAGGCU | 308-330_G21A |
| AD-62938 | 513 | AAACAUGGUGUGGAUGGGAUA | 535 | UAUCCCAUCCACACCAUGUUUAA | 763-785_C21A |

TABLE 2c

Additional HAO1 unmodified sequences

| Duplex Name | SEQ ID NO: | Sense strand sequence | SEQ ID NO: | Antisense strand sequence | Position in NM_017545.2 |
|---|---|---|---|---|---|
| AD-62933.2 | 394 | GAAUGUGAAAGUCAUCGACAA | 443 | UUGUCGAUGACUUUCACAUUCUG | 1072-1094 |
| AD-62939.2 | 395 | UUUUCAAUGGUGUCCUAGGA | 444 | UCCUAGGACACCCAUUGAAAAGU | 1302-1324 |
| AD-62944.2 | 396 | GAAAGUCAUCGACAAGACAUU | 445 | AAUGUCUUGUCGAUGACUUUCAC | 1078-1100 |

TABLE 2c-continued

Additional HA01 unmodified sequences

| Duplex Name | SEQ ID NO: | Sense strand sequence | SEQ ID NO: | Antisense strand sequence | Position in NM_017545.2 |
|---|---|---|---|---|---|
| AD-62949.2 | 397 | UCAUCGACAAGACAUUGGUGA | 446 | UCACCAAUGUCUUGUCGAUGACU | 1083-1105 |
| AD-62954.2 | 398 | UUUCAAUGGGUGUCCUAGGAA | 447 | UUCCUAGGACACCCAUUGAAAAG | 1303-1325 |
| AD-62959.2 | 399 | AAUGGGUGUCCUAGGAACCUU | 448 | AAGGUUCCUAGGACACCCAUUGA | 1307-1329 |
| AD-62964.2 | 400 | GACAGUGCACAAUAUUUUCCA | 449 | UGGAAAAUAUUGUGCACUGUCAG | 1134-1156_C21A |
| AD-62969.2 | 401 | ACUUUUCAAUGGGUGUCCUAA | 450 | UUAGGACACCCAUUGAAAAGUCA | 1300-1322_G21A |
| AD-62934.2 | 402 | AAGUCAUCGACAAGACAUUGA | 451 | UCAAUGUCUUGUCGAUGACUUUC | 1080-1102_G21A |
| AD-62940.2 | 403 | AUCGACAAGACAUUGGUGAGA | 452 | UCUCACCAAUGUCUUGUCGAUGA | 1085-1107_G21A |
| AD-62945.2 | 404 | GGGAGAAAGGUGUUCAAGAUA | 453 | UAUCUUGAACACCUUUCUCCCCC | 996-1018_G21A |
| AD-62950.2 | 405 | CUUUUCAAUGGGUGUCCUAGA | 454 | UCUAGGACACCCAUUGAAAAGUC | 1301-1323_G21A |
| AD-62955.2 | 406 | UCAAUGGGUGUCCUAGGAACA | 455 | UGUUCCUAGGACACCCAUUGAAA | 1305-1327_C21A |
| AD-62960.2 | 407 | UUGACUUUUCAAUGGGUGUCA | 456 | UGACACCCAUUGAAAAGUCAAAA | 1297-1319_C21A |
| AD-62965.2 | 408 | AAAGUCAUCGACAAGACAUUA | 457 | UAAUGUCUUGUCGAUGACUUUCA | 1079-1101_G21A |
| AD-62970.2 | 409 | CAGGGGGAGAAAGGUGUUCAA | 458 | UUGAACACCUUUCUCCCCCUGGA | 992-1014 |
| AD-62935.2 | 410 | CAUUGGUGAGGAAAAAUCCUU | 459 | AAGGAUUUUUCCUCACCAAUGUC | 1095-1117 |
| AD-62941.2 | 411 | ACAUUGGUGAGGAAAAAUCCU | 460 | AGGAUUUUUCCUCACCAAUGUCU | 1094-1116 |
| AD-62946.2 | 412 | AGGGGGAGAAAGGUGUUCAAA | 461 | UUUGAACACCUUUCUCCCCCUGG | 993-1015_G21A |
| AD-62974.2 | 413 | CUCAGGAUGAAAAAUUUUGAA | 462 | UUCAAAAUUUUUCAUCCUGAGUU | 563-585 |
| AD-62978.2 | 414 | CAGCAUGUAUUACUUGACAAA | 463 | UUUGUCAAGUAAUACAUGCUGAA | 1173-1195 |
| AD-62982.2 | 415 | UAUGAACAACAUGCUAAAUCA | 464 | UGAUUUAGCAUGUUGUUCAUAAU | 53-75 |
| AD-62986.2 | 416 | AUAUAUCCAAAUGUUUUAGGA | 465 | UCCUAAAACAUUUGGAUAUAUUC | 1679-1701 |
| AD-62990.2 | 417 | CCAGAUGGAAGCUGUAUCCAA | 466 | UUGGAUACAGCUUCCAUCUGGAA | 156-178 |
| AD-62994.2 | 418 | GACUUUCAUCCUGGAAAUAUA | 467 | UAUAUUUCCAGGAUGAAAGUCCA | 1341-1363 |
| AD-62998.2 | 419 | CCCCGGCUAAUUUGUAUCAAU | 468 | AUUGAUACAAAUUAGCCGGGGA | 29-51 |
| AD-63002.2 | 420 | UUAAACAUGGCUUGAAUGGGA | 469 | UCCCAUUCAAGCCAUGUUUAACA | 765-787 |
| AD-62975.2 | 421 | AAUGUGUUUAGACAACGUCAU | 470 | AUGACGUUGUCUAAACACAUUUU | 1388-1410 |
| AD-62979.2 | 422 | ACUAAAGGAAGAAUUCCGGUU | 471 | AACCGGAAUUCUUCCUUUAGUAU | 1027-1049 |
| AD-62983.2 | 423 | UAUAUCCAAAUGUUUUAGGAU | 472 | AUCCUAAAACAUUUGGAUAUAUU | 1680-1702 |
| AD-62987.2 | 424 | GUGCGGAAAGGCACUGAUGUU | 473 | AACAUCAGUGCCUUUCCGCACAC | 902-924 |
| AD-62991.2 | 425 | UAAACAGUGGUUCUUAAAUU | 474 | AAUUUAAGAACCACUGUUUUAAA | 1521-1543 |
| AD-62995.2 | 426 | AUGAAAAAUUUUGAAACCAGU | 475 | ACUGGUUUCAAAUUUUUCAUCC | 569-591 |
| AD-62999.2 | 427 | AACAAAAUAGCAAUCCCUUUU | 476 | AAAAGGGAUUGCUAUUUUGUUGG | 1264-1286 |
| AD-63003.2 | 428 | CUGAAACAGAUCUGUCGACUU | 477 | AAGUCGACAGAUCUGUUUCAGCA | 195-217 |
| AD-62976.2 | 429 | UUGUUGCAAAGGGCAUUUUGA | 478 | UCAAAAUGCCCUUUGCAACAAUU | 720-742 |
| AD-62980.2 | 430 | CUCAUUGUUUAUUAACCUGUA | 479 | UACAGGUUAAUAAACAAUGAGAU | 1483-1505 |
| AD-62984.2 | 431 | CAACAAAAUAGCAAUCCCUUU | 480 | AAAGGGAUUGCUAUUUUGUUGGA | 1263-1285 |
| AD-62992.2 | 432 | CAUUGUUUAUUAACCUGUAUU | 481 | AAUACAGGUUAAUAAACAAUGAG | 1485-1507 |
| AD-62996.2 | 433 | UAUCAGCUGGGAAGAUAUCAA | 482 | UUGAUAUCUUCCCAGCUGAUAGA | 670-692 |
| AD-63000.2 | 434 | UGUCCUAGGAACCUUUUAGAA | 483 | UUCUAAAAGGUUCCUAGGACACC | 1313-1335 |

TABLE 2c-continued

Additional HA01 unmodified sequences

| Duplex Name | SEQ ID NO: | Sense strand sequence | SEQ ID NO: | Antisense strand sequence | Position in NM_017545.2 |
|---|---|---|---|---|---|
| AD-63004.2 | 435 | UCCAACAAAAUAGCAAUCCCU | 484 | AGGGAUUGCUAUUUUGUUGGAAA | 1261-1283 |
| AD-62977.2 | 436 | GGUGUGCGGAAAGGCACUGAU | 485 | AUCAGUGCCUUUCCGCACACCCC | 899-921 |
| AD-62981.2 | 437 | UUGAAACCAGUACUUUAUCAU | 486 | AUGAUAAAGUACUGGUUUCAAAA | 579-601 |
| AD-62985.2 | 438 | UACUUCCAAAGUCUAUAUAUA | 487 | UAUAUAUAGACUUUGGAAGUACU | 75-97_G21A |
| AD-62989.2 | 439 | UCCUAGGAACCUUUUAGAAAU | 488 | AUUUCUAAAAGGUUCCUAGGACA | 1315-1337_G21U |
| AD-62993.2 | 440 | CUCCUGAGGAAAAUUUUGGAA | 489 | UUCCAAAAUUUUCCUCAGGAGAA | 603-625_G21A |
| AD-62997.2 | 441 | GCUCCGGAAUGUUGCUGAAAU | 490 | AUUUCAGCAACAUUCCGGAGCAU | 181-203_C21U |
| AD-63001.2 | 442 | GUGUUUGUGGGGAGACCAAUA | 491 | UAUUGGUCUCCCCACAAACACAG | 953-975_C21A |
| AD-62951.2 | 492 | AUGGUGGUAAUUUGUGAUUUU | 514 | AAAAUCACAAAUUACCACCAUCC | 1642-1664 |
| AD-62956.2 | 493 | GACUUGCAUCCUGGAAAUAUA | 515 | UAUAUUUCCAGGAUGCAAGUCCA | 1338-1360 |
| AD-62961.2 | 494 | GGAAGGGAAGGUAGAAGUCUU | 516 | AAGACUUCUACCUUCCCUUCCAC | 864-886 |
| AD-62966.2 | 495 | UGUCUUCUGUUUAGAUUUCCU | 517 | AGGAAAUCUAAACAGAAGACAGG | 1506-1528 |
| AD-62971.2 | 496 | CUUUGGCUGUUUCCAAGAUCU | 518 | AGAUCUUGGAAACAGCCAAAGGA | 1109-1131 |
| AD-62936.2 | 497 | AAUGUGUUUGGGCAACGUCAU | 519 | AUGACGUUGCCCAAACACAUUUU | 1385-1407 |
| AD-62942.2 | 498 | UGUGACUGUGGACACCCCUUA | 520 | UAAGGGGUGUCCACAGUCACAAA | 486-508 |
| AD-62947.2 | 499 | GAUGGGGUGCCAGCUACUAUU | 521 | AAUAGUAGCUGGCACCCCAUCCA | 814-836 |
| AD-62952.2 | 500 | GAAAAUGUGUUUGGGCAACGU | 522 | ACGUUGCCCAAACACAUUUUCAA | 1382-1404 |
| AD-62957.2 | 501 | GGCUGUUUCCAAGAUCUGACA | 523 | UGUCAGAUCUUGGAAACAGCCAA | 1113-1135 |
| AD-62962.2 | 502 | UCCAACAAAAUAGCCACCCCU | 524 | AGGGGUGGCUAUUUUGUUGGAAA | 1258-1280 |
| AD-62967.2 | 503 | GUCUUCUGUUUAGAUUUCCUU | 525 | AAGGAAAUCUAAACAGAAGACAG | 1507-1529 |
| AD-62972.2 | 504 | UGGAAGGGAAGGUAGAAGUCU | 526 | AGACUUCUACCUUCCCUUCCACA | 863-885 |
| AD-62937.2 | 505 | UCCUUUGGCUGUUUCCAAGAU | 527 | AUCUUGGAAACAGCCAAAGGAUU | 1107-1129 |
| AD-62943.2 | 506 | CAUCUCUCAGCUGGGAUGAUA | 528 | UAUCAUCCCAGCUGAGAGAUGGG | 662-684 |
| AD-62948.2 | 507 | GGGGUGCCAGCUACUAUUGAU | 529 | AUCAAUAGUAGCUGGCACCCCAU | 817-839 |
| AD-62953.2 | 508 | AUGUGUUUGGGCAACGUCAUA | 530 | UAUGACGUUGCCCAAACACAUUU | 1386-1408_C21A |
| AD-62958.2 | 509 | CUGUUUAGAUUUCCUUAAGAA | 531 | UUCUUAAGGAAAUCUAAACAGAA | 1512-1534_C21A |
| AD-62963.2 | 510 | AGAAAGAAAUGGACUUGCAUA | 532 | UAUGCAAGUCCAUUUCUUUCUAG | 1327-1349_C21A |
| AD-62968.2 | 511 | GCAUCCUGGAAAUAUAUUAAA | 533 | UUUAAUAUAUUUCCAGGAUGCAA | 1343-1365_C21A |
| AD-62973.2 | 512 | CCUGUCAGACCAUGGGAACUA | 534 | UAGUUCCCAUGGUCUGACAGGCU | 308-330_G21A |
| AD-62938.2 | 513 | AAACAUGGUGUGGAUGGGAUA | 535 | UAUCCCAUCCACACCAUGUUUAA | 763-785_C21A |
| AD-62933.1 | 536 | GAAUGUGAAAGUCAUCGACAA | 653 | UUGUCGAUGACUUUCACAUUCUG | 1072-1094 |
| AD-65630.1 | 537 | GAAUGUGAAAGUCAUCGACAA | 654 | UUGUCGAUGACUUUCACAUUCUG | 1072-1094 |
| AD-65636.1 | 538 | GAAUGUGAAAGUCAUCGACAA | 655 | UUGUCGAUGACUUUCACAUUCUG | 1072-1094 |
| AD-65642.1 | 539 | GAAUGUGAAAGUCAUCGACAA | 656 | UUGUCGAUGACUUUCACAUUCUG | 1072-1094 |
| AD-65647.1 | 540 | GAAUGUGAAAGUCAUCGACAA | 657 | UUGUCGAUGACUUUCACAUUCUG | 1072-1094 |
| AD-65652.1 | 541 | GAAUGUGAAAGUCAUCGACAA | 658 | UUGUCGAUGACUUUCACAUUCUG | 1072-1094 |
| AD-65657.1 | 542 | GAAUGUGAAAGUCAUCGACAA | 659 | UUGUCGAUGACUUUCACAUUCUG | 1072-1094 |

TABLE 2c-continued

Additional HA01 unmodified sequences

| Duplex Name | SEQ ID NO: | Sense strand sequence | SEQ ID NO: | Antisense strand sequence | Position in NM_017545.2 |
|---|---|---|---|---|---|
| AD-65662.1 | 543 | GAAUGUGAAAGUCAUCGACAA | 660 | UUGUCGAUGACUUUCACAUUCUG | 1072-1094 |
| AD-65625.1 | 544 | AUGUGAAAGUCAUCGACAA | 661 | UUGUCGAUGACUUUCACAUUC | 1072-1094 |
| AD-65631.1 | 545 | AUGUGAAAGUCAUCGACAA | 662 | UUGUCGAUGACUUUCACAUUC | 1072-1094 |
| AD-63037.1 | 546 | GAAUGUGAAAGUCAUCGACAA | 663 | UUGUCGAUGACUUUCACAUUCUG | 1072-1094 |
| AD-65643.1 | 547 | GAAUGUGAAAGUCAUCGACAA | 664 | UUGUCGAUGACUUUCACAUUCUG | 1072-1094 |
| AD-65648.1 | 548 | GAAUGUGAAAGUCAUCGACAA | 665 | UUGUCGAUGACUUUCACAUUCUG | 1072-1094 |
| AD-65653.1 | 549 | GAAUGUGAAAGUCAUCGACAA | 666 | UUGUCGAUGACUUUCACAUUCUG | 1072-1094 |
| AD-65658.1 | 550 | GAAUGUGAAAGUCAUCGACAA | 667 | UUGUCGAUGACUUUCACAUUCUG | 1072-1094 |
| AD-65663.1 | 551 | GAAUGUGAAAGUCAUCGACAA | 668 | UUGUCGAUGACUUUCACAUUCUG | 1072-1094 |
| AD-65626.1 | 552 | GAAUGUGAAAGUCAUCGACAA | 669 | UUGUCGAUGACUUUCACAUUCUG | 1072-1094 |
| AD-65638.1 | 553 | GAAUGUGAAAGUCAUCGACAA | 670 | UUGUCGAUGACUUUCACAUUCUG | 1072-1094 |
| AD-65644.1 | 554 | GAAUGUGAAAGUCAUCGACAA | 671 | UUGUCGAUGACUUUCACAUUCUG | 1072-1094 |
| AD-65649.1 | 555 | GAAUGUGAAAGUCAUCGACAA | 672 | UUGUCGAUGACUUUCACAUUCUG | 1072-1094 |
| AD-65654.1 | 556 | GAAUGUGAAAGUCAUCGACAA | 673 | UUGUCGAUGACUUUCACAUUCUG | 1072-1094 |
| AD-65659.1 | 557 | GAAUGTGAAAGUCAUCGACAA | 674 | UUGUCGAUGACUUUCACAUUCUG | 1072-1094 |
| AD-65627.1 | 558 | GAAUGUGAAAGUCAUCGACAA | 675 | UUGUCGAUGACUUUCACAUUCUG | 1072-1094 |
| AD-63033.1 | 559 | GAAUGTGAAAGUCAUCGACAA | 676 | UUGUCGAUGACUUUCACAUUCUG | 1072-1094 |
| AD-65639.1 | 560 | GAAUGUGAAAGUCAUCGACAA | 677 | UUGUCGAUGACUUUCACAUUCUG | 1072-1094 |
| AD-65645.1 | 561 | GAAUGUGAAAGUCAUCGACAA | 678 | UUGUCGAUGACUUUCACAUUCUG | 1072-1094 |
| AD-65650.1 | 562 | GAAUGUGAAAGUCAUCGACAA | 679 | UUGUCGAUGACUUUCACAUUCUG | 1072-1094 |
| AD-65655.1 | 563 | GAAUGUGAAAGUCAUCACAA | 680 | UUGUCGAUGACUUUCACAUUCUG | 1072-1094 |
| AD-65660.1 | 564 | GAAUGUGAAAGUCATCTACAA | 681 | UUGUCGAUGACUUUCACAUUCUG | 1072-1094 |
| AD-65665.1 | 565 | GAAUGUGAAAGUCAUCGACAA | 682 | UUGUCGAUGACUUUCACAUUCUG | 1072-1094 |
| AD-65628.1 | 566 | GAAUGUGAAAGUCAUCTACAA | 683 | UUGUCGAUGACUUUCACAUUCUG | 1072-1094 |
| AD-65634.1 | 567 | GAAUGUGAAAGUCAUCACAA | 684 | UUGUCGAUGACUUUCACAUUCUG | 1072-1094 |
| AD-65646.1 | 568 | GAAUGUGAAAGUCAUCGACAA | 685 | UTGUCGAUGACUUTCACAUUCUG | 1072-1094 |
| AD-65656.1 | 569 | GAAUGUGAAAGUCAUCGACAA | 686 | UUGUCGAUGACUUTCACAUUCUG | 1072-1094 |
| AD-65661.1 | 570 | GAAUGUGAAAGUCAUCGACAA | 687 | UTGUCGAUGACUUTCACAUUCUG | 1072-1094 |
| AD-65666.1 | 571 | GAAUGUGAAAGUCAUCGACAA | 688 | UUGUCGAUGACUUTCACAUUCUG | 1072-1094 |
| AD-65629.1 | 572 | GAAUGUGAAAGUCAUCGACAA | 689 | UTGUCGAUGACUUTCACAUUCUG | 1072-1094 |
| AD-65635.1 | 573 | GAAUGUGAAAGUCAUCGACAA | 690 | UTGUCGAUGACUUTCACAUUCUG | 1072-1094 |
| AD-65641.1 | 574 | GAAUGUGAAAGUCAUCGACAA | 691 | UTGUCGAUGACUUTCACAUUCUG | 1072-1094 |
| AD-62994.1 | 575 | GACUUUCAUCCUGGAAAUAUA | 692 | UAUAUUUCCAGGAUGAAAGUCCA | 1341-1363 |
| AD-65595.1 | 576 | GACUUUCAUCCUGGAAAUAUA | 693 | UAUAUUUCCAGGAUGAAAGUCCA | 1341-1363 |
| AD-65600.1 | 577 | GACUUUCAUCCUGGAAAUAUA | 694 | UAUAUUUCCAGGAUGAAAGUCCA | 1341-1363 |
| AD-65610.1 | 578 | GACUUUCAUCCUGGAAAUAUA | 695 | UAUAUUUCCAGGAUGAAAGUCCA | 1341-1363 |
| AD-65615.1 | 579 | GACUUUCAUCCUGGAAAUAUA | 696 | UAUAUUUCCAGGAUGAAAGUCCA | 1341-1363 |
| AD-65620.1 | 580 | GACUUUCAUCCUGGAAAUAUA | 697 | UAUAUUUCCAGGAUGAAAGUCCA | 1341-1363 |

TABLE 2c-continued

Additional HA01 unmodified sequences

| Duplex Name | SEQ ID NO: | Sense strand sequence | SEQ ID NO: | Antisense strand sequence | Position in NM_017545.2 |
|---|---|---|---|---|---|
| AD-65584.1 | 581 | CUUUCAUCCUGGAAAUAUA | 698 | UAUAUUUCCAGGAUGAAAGUC | 1341-1361 |
| AD-65590.1 | 582 | CUUUCAUCCUGGAAAUAUA | 699 | UAUAUUUCCAGGAUGAAAGUC | 1341-1361 |
| AD-65596.1 | 583 | GACUUUCAUCCUGGAAAUAUA | 700 | UAUAUUUCCAGGAUGAAAGUCCA | 1341-1363 |
| AD-65601.1 | 584 | GACUUUCAUCCUGGAAAUAUA | 701 | UAUAUUUCCAGGAUGAAAGUCCA | 1341-1363 |
| AD-65606.1 | 585 | GACUUUCAUCCUGGAAAUAUA | 702 | UAUAUUUCCAGGAUGAAAGUCCA | 1341-1363 |
| AD-65611.1 | 586 | GACUUUCAUCCUGGAAAUAUA | 703 | UAUAUUUCCAGGAUGAAAGUCCA | 1341-1363 |
| AD-65616.1 | 587 | GACUUUCAUCCUGGAAAUAUA | 704 | UAUAUUUCCAGGAUGAAAGUCCA | 1341-1363 |
| AD-65621.1 | 588 | GACUUUCAUCCUGGAAAUAUA | 705 | UAUAUUUCCAGGAUGAAAGUCCA | 1341-1363 |
| AD-65585.1 | 589 | GACUUUCAUCCUGGAAAUAUA | 706 | UAUAUUUCCAGGAUGAAAGUCCA | 1341-1363 |
| AD-65591.1 | 590 | GACUUUCAUCCUGGAAAUAUA | 707 | UAUAUUUCCAGGAUGAAAGUCCA | 1341-1363 |
| AD-65597.1 | 591 | GACUUUCAUCCUGGAAAUAUA | 708 | UAUAUUUCCAGGAUGAAAGUCCA | 1341-1363 |
| AD-65602.1 | 592 | GACUUUCAUCCUGGAAAUAUA | 709 | UAUAUUUCCAGGAUGAAAGUCCA | 1341-1363 |
| AD-65607.1 | 593 | GACUUUCAUCCUGGAAAUAUA | 710 | UAUAUUUCCAGGAUGAAAGUCCA | 1341-1363 |
| AD-65612.1 | 594 | GACUUUCAUCCUGGAAAUAUA | 711 | UAUAUUUCCAGGAUGAAAGUCCA | 1341-1363 |
| AD-65622.1 | 595 | GACUUUCAUCCUGGAAAUAUA | 712 | UAUAUUUCCAGGAUGAAAGUCCA | 1341-1363 |
| AD-65586.1 | 596 | GACUTUCAUCCUGGAAAUAUA | 713 | UAUAUUUCCAGGAUGAAAGUCCA | 1341-1363 |
| AD-65592.1 | 597 | GACUUTCAUCCUGGAAAUAUA | 714 | UAUAUUUCCAGGAUGAAAGUCCA | 1341-1363 |
| AD-65598.1 | 598 | GACUUUCAUCCUGGAAAUAUA | 715 | UAUAUUUCCAGGAUGAAAGUCCA | 1341-1363 |
| AD-65603.1 | 599 | GACUUUCAUCCUGGAAAUAUA | 716 | UAUAUUUCCAGGAUGAAAGUCCA | 1341-1363 |
| AD-65608.1 | 600 | GACUUUCAUCCUGGAATUAUA | 717 | UAUAUUUCCAGGAUGAAAGUCCA | 1341-1363 |
| AD-65613.1 | 601 | GACUUUCAUCCUGGAAAUAUA | 718 | UAUAUUUCCAGGAUGAAAGUCCA | 1341-1363 |
| AD-65618.1 | 602 | GACUUUCAUCCUGGAATUAUA | 719 | UAUAUUUCCAGGAUGAAAGUCCA | 1341-1363 |
| AD-65623.1 | 603 | GACUUUCAUCCUGGAATUAUA | 720 | UAUAUUUCCAGGAUGAAAGUCCA | 1341-1363 |
| AD-65587.1 | 604 | GACUUUCAUCCUGGAAAUAUA | 721 | UAUAUUUCCAGGAUGAAAGUCCA | 1341-1363 |
| AD-65593.1 | 605 | GACUUTCAUCCUGGAAAUAUA | 722 | UAUAUUUCCAGGAUGAAAGUCCA | 1341-1363 |
| AD-65599.1 | 606 | GACUUUCAUCCUGGAAAUAUA | 723 | UAUAUUUCCAGGATGAAAGUCCA | 1341-1363 |
| AD-65604.1 | 607 | GACUUUCAUCCUGGAAAUAUA | 724 | UAUAUUUCCAGGATGAAAGUCCA | 1341-1363 |
| AD-65609.1 | 608 | GACUUUCAUCCUGGAAAUAUA | 725 | UAUAUUUCCAGGATGAAAGUCCA | 1341-1363 |
| AD-65614.1 | 609 | GACUUUCAUCCUGGAAAUAUA | 726 | UAUAUUCCAGGATGAAAGUCCA | 1341-1363 |
| AD-65619.1 | 610 | GACUUUCAUCCUGGAAAUAUA | 727 | UAUAUUCCAGGATGAAAGUCCA | 1341-1363 |
| AD-65624.1 | 611 | GACUUUCAUCCUGGAAAUAUA | 728 | UAUAUUUCCAGGATGAAAGUCCA | 1341-1363 |
| AD-65588.1 | 612 | GACUUUCAUCCUGGAAAUAUA | 729 | UAUAUUCCAGGATGAAAGUCCA | 1341-1363 |
| AD-65594.1 | 613 | GACUUUCAUCCUGGAAAUAUA | 730 | UAUAUUUCCAGGATGAAAGUCCA | 1341-1363 |
| AD-68309.1 | 614 | AGAAAGGUGUUCAAGAUGUCA | 731 | UGACAUCUUGAACACCUUUCUCC | 1001-1022_C21A |
| AD-68303.1 | 615 | CAUCCUGGAAAUAUAUUAACU | 732 | AGUUAAUAUAUUUCCAGGAUGAA | 1349-1370 |
| AD-65626.5 | 616 | GAAUGUGAAAGUCAUCGACAA | 733 | UUGUCGAUGACUUUCACAUUCUG | 1072-1094 |
| AD-68295.1 | 617 | AGUGCACAAUAUUUUCCCAUA | 734 | UAUGGGAAAAUAUUGUGCACUGU | 1139-1160_C21A |

TABLE 2c-continued

Additional HA01 unmodified sequences

| Duplex Name | SEQ ID NO: | Sense strand sequence | SEQ ID NO: | Antisense strand sequence | Position in NM_017545.2 |
|---|---|---|---|---|---|
| AD-68273.1 | 618 | GAAAGUCAUCGACAAGACAUU | 735 | AAUGUCUUGUCGAUGACUUUCAC | 1080-1100 |
| AD-68297.1 | 619 | AAUGUGAAAGUCAUCGACAAA | 736 | UUUGUCGAUGACUUUCACAUUCU | 1075-1096_G21A |
| AD-68287.1 | 620 | CUGGAAAUAUAUUAACUGUUA | 737 | UAACAGUUAAUAUAUUUCCAGGA | 1353-1374 |
| AD-68300.1 | 621 | AUUUUCCCAUCUGUAUUAUUU | 738 | AAAUAAUACAGAUGGGAAAAUAU | 1149-1170 |
| AD-68306.1 | 622 | UGUCGUUCUUUUCCAACAAAA | 739 | UUUUGUUGGAAAAGAACGACACC | 1252-1273 |
| AD-68292.1 | 623 | AUCCUGGAAAUAUAUUAACUA | 740 | UAGUUAAUAUAUUUCCAGGAUGA | 1350-1371_G21A |
| AD-68298.1 | 624 | GCAUUUGAGAGGUGAUGAUA | 741 | UAUCAUCACCUCUCAAAAUGCCC | 734-755_G21A |
| AD-68277.1 | 625 | CAGGGGGAGAAAGGUGUUCAA | 742 | UUGAACACCUUUCUCCCCCUGGA | 994-1014 |
| AD-68289.1 | 626 | GGAAAUAUAUUAACUGUUAAA | 743 | UUUAACAGUUAAUAUAUUUCCAG | 1355-1376 |
| AD-68272.1 | 627 | CAUUGGUGAGGAAAAAUCCUU | 744 | AAGGAUUUUUCCUCACCAAUGUC | 1097-1117 |
| AD-68282.1 | 628 | GGGAGAAAGGUGUUCAAGAUA | 745 | UAUCUUGAACACCUUUCUCCCCC | 998-1018_G21A |
| AD-68285.1 | 629 | GGCAUUUGAGAGGUGAUGAU | 746 | AUCAUCACCUCUCAAAAUGCCCU | 733-754 |
| AD-68290.1 | 630 | UACAAAGGGUGUCGUUCUUUU | 747 | AAAAGAACGACACCCUUUGUAUU | 1243-1264 |
| AD-68296.1 | 631 | UGGGAUCUUGGUGUCGAAUCA | 748 | UGAUUCGACACCAAGAUCCCAUU | 783-804 |
| AD-68288.1 | 632 | CUGACAGUGCACAAUAUUUUA | 749 | UAAAAUAUUGUGCACUGUCAGAU | 1134-1155_C21A |
| AD-68299.1 | 633 | CAGUGCACAAUAUUUUCCCAU | 750 | AUGGGAAAAUAUUGUGCACUGUC | 1138-1159 |
| AD-68275.1 | 634 | ACUUUUCAAUGGGUGUCCUAA | 751 | UUAGGACACCCAUUGAAAAGUCA | 1302-1322_G21A |
| AD-68274.1 | 635 | ACAUUGGUGAGGAAAAAUCCU | 752 | AGGAUUUUUCCUCACCAAUGUCU | 1096-1116 |
| AD-68294.1 | 636 | UUGCUUUUGACUUUUCAAUGA | 753 | UCAUUGAAAAGUCAAAAGCAAUG | 1293-1314_G21A |
| AD-68302.1 | 637 | CAUUUUGAGAGGUGAUGAUGA | 754 | UCAUCAUCACCUCUCAAAAUGCC | 735-756_C21A |
| AD-68279.1 | 638 | UUGACUUUUCAAUGGGUGUCA | 755 | UGACACCCAUUGAAAAGUCAAAA | 1299_1319_C21A |
| AD-68304.1 | 639 | CGACUUCUGUUUUAGGACAGA | 756 | UCUGUCCUAAAACAGAAGUCGAC | 212-233 |
| AD-68286.1 | 640 | CUCUGAGUGGGUGCCAGAAUA | 757 | UAUUCUGGCACCCACUCAGAGCC | 1058-1079_G21A |
| AD-68291.1 | 641 | GGGUGCCAGAAUGUGAAAGUA | 758 | UACUUUCACAUUCUGGCACCCAC | 1066-1087_C21A |
| AD-68283.1 | 642 | UCAAUGGGUGUCCUAGGAACA | 759 | UGUUCCUAGGACACCCAUUGAAA | 1307-1327_C21A |
| AD-68280.1 | 643 | AAAGUCAUCGACAAGACAUUA | 760 | UAAUGUCUUGUCGAUGACUUUCA | 1081-1101_G21A |
| AD-68293.1 | 644 | AUUUGAGAGGUGAUGAUGCA | 761 | UGCAUCAUCACCUCUCAAAAUGC | 736-757_C21A |
| AD-68276.1 | 645 | AUCGACAAGACAUUGGUGAGA | 762 | UCUCACCAAUGUCUUGUCGAUGA | 1087-1107_G21A |
| AD-68308.1 | 646 | GGUGCCAGAAUGUGAAAGUCA | 763 | UGACUUUCACAUUCUGGCACCCA | 1067-1088 |
| AD-68278.1 | 647 | GACAGUGCACAAUAUUUUCCA | 764 | UGGAAAAUAUUGUGCACUGUCAG | 1136-1156_C21A |
| AD-68307.1 | 648 | ACAAAGAGACACUGUGCAGAA | 765 | UUCUGCACAGUGUCUCUUUGUCA | 1191-1212_G21A |
| AD-68284.1 | 649 | UUUUCAAUGGGUGUCCUAGGA | 766 | UCCUAGGACACCCAUUGAAAAGU | 1304-1324 |
| AD-68301.1 | 650 | CCGUUUCCAAGAUCUGACAGU | 767 | ACUGUCAGAUCUUGGAAACGGCC | 1121-1142 |
| AD-68281.1 | 651 | AGGGGGAGAAAGGUGUUCAAA | 768 | UUUGAACACCUUUCUCCCCCUGG | 995-1015_G21A |
| AD-68305.1 | 652 | AGUCAUCGACAAGACAUUGGU | 769 | ACCAAUGUCUUGUCGAUGACUUU | 1083-1104 |

Example 2. In Vitro Single Dose Screen in Primary Monkey Hepatocytes

The modified and conjugated HAO1 siRNA duplexes were evaluated for efficacy by transfection assays in primary monkey hepatocytes. HAO1 siRNAs were transfected at two doses, 10 nM and 0.1 nM. The results of these assays are shown in Table 3 and the data are expressed as a fraction of the message remaining in cells transfected with siRNAs targeting HAO1, relative to cells transfected with a negative control siRNA, AD-1955±the standard deviation (SD).

Figure 3B:
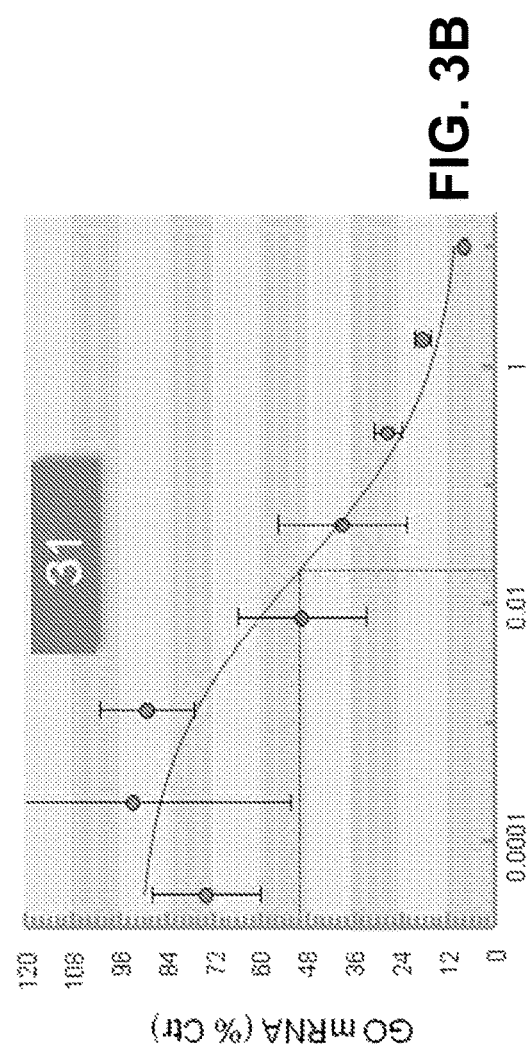
FIG. 3B is a graph with the dose response curve of a GO (HAO) GalNac-siRNA conjugate in primary cynomologous monkey hepatocytes.

The results are also shown in FIG. 3A. FIG. 3B illustrates a dose response with one of the most active conjugates (#31) (AD-62933) from the primary two dose screen; the IC50 was ~19 pM.

TABLE 3a

HAO1 single dose screen in monkey hepatocytes.

| DUPLEX ID | Species | 10 nM PCH | 0.1 nM PCH | SD 10 nM PCH | SD 0.1 nM PCH |
|---|---|---|---|---|---|
| AD-62974 | Hs | 5.3 | 29.8 | 1.87 | 11.11 |
| AD-62975 | Hs | 7.6 | 31.3 | 0.34 | 1.99 |
| AD-62976 | Hs | 4.7 | 35.5 | 0.34 | 13.90 |
| AD-62977 | Hs | 29.2 | 66.9 | 8.32 | 43.88 |
| AD-62978 | Hs | 3.8 | 8.9 | 0.15 | 4.29 |
| AD-62979 | Hs | 27.5 | 80.7 | 1.35 | 19.58 |
| AD-62980 | Hs | 7.4 | 32.2 | 1.26 | 1.42 |
| AD-62981 | Hs | 18.7 | 49.9 | 3.46 | 12.83 |
| AD-62982 | Hs | 2.2 | 8.5 | 0.10 | 7.71 |
| AD-62983 | Hs | 19.4 | 41.0 | 11.19 | 6.60 |
| AD-62984 | Hs | 6.7 | 13.3 | 1.05 | 2.60 |
| AD-62985 | Hs | 2.3 | 8.3 | 0.24 | 2.68 |
| AD-62986 | Hs | 39.0 | 57.2 | 3.82 | 16.31 |
| AD-62987 | Hs | 11.5 | 17.8 | 14.62 | 15.39 |
| AD-62989 | Hs | 10.6 | 34.2 | 2.23 | 2.68 |
| AD-62990 | Hs | 12.0 | 18.4 | 9.11 | 5.23 |
| AD-62991 | Hs | 7.2 | 14.2 | 1.30 | 2.96 |
| AD-62992 | Hs | 3.9 | 16.0 | 1.15 | 1.80 |
| AD-62993 | Hs | 22.3 | 58.4 | 9.91 | 6.28 |
| AD-62994 | Hs | 3.2 | 10.8 | 1.21 | 1.69 |
| AD-62995 | Hs | 5.5 | 17.6 | 4.58 | 3.25 |
| AD-62996 | Hs | 3.4 | 20.7 | 2.16 | 3.73 |
| AD-62997 | Hs | 4.5 | 24.2 | 0.67 | 3.32 |
| AD-62998 | Hs | 4.3 | 14.7 | 0.49 | 0.29 |
| AD-62999 | Hs | 11.4 | 15.5 | 1.23 | 2.50 |
| AD-63000 | Hs | 45.5 | 90.6 | 13.41 | 43.49 |
| AD-63001 | Hs | 13.3 | 31.0 | 0.20 | 2.13 |
| AD-63002 | Hs | 6.6 | 22.0 | 0.26 | 5.75 |
| AD-63003 | Hs | 36.8 | 5.1 | 47.09 | 0.60 |
| AD-63004 | Hs | 12.7 | 35.4 | 1.55 | 9.42 |
| AD-62933 | Hs/Mm | 5.8 | 13.4 | 0.71 | 0.13 |
| AD-62934 | Hs/Mm | 52.2 | 35.9 | 6.64 | 5.08 |
| AD-62935 | Hs/Mm | 7.7 | 22.7 | 1.53 | 4.97 |
| AD-62939 | Hs/Mm | 25.1 | 49.0 | 9.48 | 2.88 |
| AD-62940 | Hs/Mm | 11.9 | 50.4 | 4.12 | 13.91 |
| AD-62941 | Hs/Mm | 9.6 | 30.3 | 7.28 | 3.11 |
| AD-62944 | Hs/Mm | 8.0 | 18.5 | 1.40 | 5.63 |
| AD-62945 | Hs/Mm | 22.9 | 36.5 | 17.16 | 13.81 |
| AD-62946 | Hs/Mm | 19.3 | 29.5 | 15.29 | 1.74 |
| AD-62949 | Hs/Mm | 34.1 | 84.2 | 18.11 | 18.42 |
| AD-62950 | Hs/Mm | 12.7 | 36.2 | 5.69 | 6.54 |
| AD-62954 | Hs/Mm | 46.0 | 53.2 | 37.57 | 10.61 |
| AD-62955 | Hs/Mm | 24.6 | 36.0 | 0.97 | 16.36 |
| AD-62959 | Hs/Mm | 32.3 | 37.4 | 12.49 | 12.08 |
| AD-62960 | Hs/Mm | 18.1 | 37.5 | 2.12 | 3.12 |
| AD-62964 | Hs/Mm | 16.2 | 52.4 | 5.59 | 22.40 |
| AD-62965 | Hs/Mm | 18.5 | 34.5 | 3.77 | 22.38 |
| AD-62969 | Hs/Mm | 11.7 | 34.0 | 0.17 | 12.55 |
| AD-62970 | Hs/Mm | 13.6 | 21.2 | 1.13 | 5.85 |
| AD-62936 | Mm | 91.3 | 55.6 | 16.03 | 0.27 |
| AD-62937 | Mm | 45.8 | 77.7 | 22.77 | 47.01 |
| AD-62938 | Mm | 78.3 | 55.1 | 8.81 | 2.70 |
| AD-62942 | Mm | 18.8 | 21.7 | 7.34 | 8.00 |
| AD-62943 | Mm | 6.7 | 31.0 | 0.79 | 7.22 |
| AD-62947 | Mm | 27.9 | 82.0 | 14.01 | 2.01 |
| AD-62948 | Mm | 21.9 | 52.5 | 6.56 | 21.01 |
| AD-62951 | Mm | 40.1 | 77.4 | 8.76 | 3.03 |
| AD-62952 | Mm | 33.7 | 69.9 | 17.76 | 1.71 |
| AD-62953 | Mm | 79.9 | 65.1 | 96.61 | 22.79 |
| AD-62956 | Mm | 7.6 | 16.4 | 1.01 | 12.39 |
| AD-62957 | Mm | 6.7 | 21.3 | 0.99 | 3.02 |
| AD-62958 | Mm | 38.9 | 54.4 | 21.66 | 29.39 |
| AD-62961 | Mm | 35.3 | 66.0 | 0.35 | 24.65 |
| AD-62962 | Mm | 70.7 | 63.7 | 21.17 | 26.36 |
| AD-62963 | Mm | 35.1 | 66.5 | 35.49 | 9.42 |
| AD-62966 | Mm | 69.0 | 100.3 | 17.07 | 3.44 |
| AD-62967 | Mm | 90.7 | 116.7 | 22.01 | 47.77 |
| AD-62968 | Mm | 46.3 | 72.2 | 28.37 | 67.08 |
| AD-62971 | Mm | 17.9 | 46.3 | 1.23 | 23.41 |
| AD-62972 | Mm | 75.6 | 122.9 | 24.75 | 18.00 |
| AD-62973 | Mm | 102.8 | 73.9 | 22.49 | 14.39 |

TABLE 3b

Additional HAO1 single dose screen in primary monkey hepatocytes.

| DUPLEX ID | Species | 10 nM PCH | 0.1 nM PCH | SD 10 nM PCH | SD 0.1 nM PCH |
|---|---|---|---|---|---|
| AD-62974.2 | Hs | 5.3 | 29.8 | 1.87 | 11.11 |
| AD-62975.2 | Hs | 7.6 | 31.3 | 0.34 | 1.99 |
| AD-62976.2 | Hs | 4.7 | 35.5 | 0.34 | 13.90 |
| AD-62977.2 | Hs | 29.2 | 66.9 | 8.32 | 43.88 |
| AD-62978.2 | Hs | 3.8 | 8.9 | 0.15 | 4.29 |
| AD-62979.2 | Hs | 27.5 | 80.7 | 1.35 | 19.58 |
| AD-62980.2 | Hs | 7.4 | 32.2 | 1.26 | 1.42 |
| AD-62981.2 | Hs | 18.7 | 49.9 | 3.46 | 12.83 |
| AD-62982.2 | Hs | 2.2 | 8.5 | 0.10 | 7.71 |
| AD-62983.2 | Hs | 19.4 | 41.0 | 11.19 | 6.60 |
| AD-62984.2 | Hs | 6.7 | 13.3 | 1.05 | 2.60 |
| AD-62985.2 | Hs | 2.3 | 8.3 | 0.24 | 2.68 |
| AD-62986.2 | Hs | 39.0 | 57.2 | 3.82 | 16.31 |
| AD-62987.2 | Hs | 11.5 | 17.8 | 14.62 | 15.39 |
| AD-62989.2 | Hs | 10.6 | 34.2 | 2.23 | 2.68 |
| AD-62990.2 | Hs | 12.0 | 18.4 | 9.11 | 5.23 |
| AD-62991.2 | Hs | 7.2 | 14.2 | 1.30 | 2.96 |
| AD-62992.2 | Hs | 3.9 | 16.0 | 1.15 | 1.80 |
| AD-62993.2 | Hs | 22.3 | 58.4 | 9.91 | 6.28 |
| AD-62994.2 | Hs | 3.2 | 10.8 | 1.21 | 1.69 |
| AD-62995.2 | Hs | 5.5 | 17.6 | 4.58 | 3.25 |
| AD-62996.2 | Hs | 3.4 | 20.7 | 2.16 | 3.73 |
| AD-62997.2 | Hs | 4.5 | 24.2 | 0.67 | 3.32 |
| AD-62998.2 | Hs | 4.3 | 14.7 | 0.49 | 0.29 |
| AD-62999.2 | Hs | 11.4 | 15.5 | 1.23 | 2.50 |
| AD-63000.2 | Hs | 45.5 | 90.6 | 13.41 | 43.49 |
| AD-63001.2 | Hs | 13.3 | 31.0 | 0.20 | 2.13 |
| AD-63002.2 | Hs | 6.6 | 22.0 | 0.26 | 5.75 |
| AD-63003.2 | Hs | 36.8 | 5.1 | 47.09 | 0.60 |
| AD-63004.2 | Hs | 12.7 | 35.4 | 1.55 | 9.42 |
| AD-62933.2 | Hs/Mm | 5.8 | 13.4 | 0.71 | 0.13 |
| AD-62934.2 | Hs/Mm | 52.2 | 35.9 | 6.64 | 5.08 |
| AD-62935.2 | Hs/Mm | 7.7 | 22.7 | 1.53 | 4.97 |
| AD-62939.2 | Hs/Mm | 25.1 | 49.0 | 9.48 | 2.88 |
| AD-62940.2 | Hs/Mm | 11.9 | 50.4 | 4.12 | 13.91 |
| AD-62941.2 | Hs/Mm | 9.6 | 30.3 | 7.28 | 3.11 |
| AD-62944.2 | Hs/Mm | 8.0 | 18.5 | 1.40 | 5.63 |
| AD-62945.2 | Hs/Mm | 22.9 | 36.5 | 17.16 | 13.81 |
| AD-62946.2 | Hs/Mm | 19.3 | 29.5 | 15.29 | 1.74 |
| AD-62949.2 | Hs/Mm | 34.1 | 84.2 | 18.11 | 18.42 |
| AD-62950.2 | Hs/Mm | 12.7 | 36.2 | 5.69 | 6.54 |
| AD-62954.2 | Hs/Mm | 46.0 | 53.2 | 37.57 | 10.61 |
| AD-62955.2 | Hs/Mm | 24.6 | 36.0 | 0.97 | 16.36 |
| AD-62959.2 | Hs/Mm | 32.3 | 37.4 | 12.49 | 12.08 |
| AD-62960.2 | Hs/Mm | 18.1 | 37.5 | 2.12 | 3.12 |
| AD-62964.2 | Hs/Mm | 16.2 | 52.4 | 5.59 | 22.40 |
| AD-62965.2 | Hs/Mm | 18.5 | 34.5 | 3.77 | 22.38 |
| AD-62969.2 | Hs/Mm | 11.7 | 34.0 | 0.17 | 12.55 |

TABLE 3b-continued

Additional HAO1 single dose screen in primary monkey hepatocytes.

| DUPLEX ID | Species | 10 nM PCH | 0.1 nM PCH | SD 10 nM PCH | SD 0.1 nM PCH |
|---|---|---|---|---|---|
| AD-62970.2 | Hs/Mm | 13.6 | 21.2 | 1.13 | 5.85 |
| AD-62936.2 | Mm | 91.3 | 55.6 | 16.03 | 0.27 |
| AD-62937.2 | Mm | 45.8 | 77.7 | 22.77 | 47.01 |
| AD-62938.2 | Mm | 78.3 | 55.1 | 8.81 | 2.70 |
| AD-62942.2 | Mm | 18.8 | 21.7 | 7.34 | 8.00 |
| AD-62943.2 | Mm | 6.7 | 31.0 | 0.79 | 7.22 |
| AD-62947.2 | Mm | 27.9 | 82.0 | 14.01 | 2.01 |
| AD-62948.2 | Mm | 21.9 | 52.5 | 6.56 | 21.01 |
| AD-62951.2 | Mm | 40.1 | 77.4 | 8.76 | 3.03 |
| AD-62952.2. | Mm | 33.7 | 69.9 | 17.76 | 1.71 |
| AD-62953.2 | Mm | 79.9 | 65.1 | 96.61 | 22.79 |
| AD-62956.2 | Mm | 7.6 | 16.4 | 1.01 | 12.39 |
| AD-62957.2 | Mm | 6.7 | 21.3 | 0.99 | 3.02 |
| AD-62958.2 | Mm | 38.9 | 54.4 | 21.66 | 29.39 |
| AD-62961.2 | Mm | 35.3 | 66.0 | 0.35 | 24.65 |
| AD-62962.2 | Mm | 70.7 | 63.7 | 21.17 | 26.36 |
| AD-62963.2 | Mm | 35.1 | 66.5 | 35.49 | 9.42 |
| AD-62966.2 | Mm | 69.0 | 100.3 | 17.07 | 3.44 |
| AD-62967.2 | Mm | 90.7 | 116.7 | 22.01 | 47.77 |
| AD-62968.2 | Mm | 46.3 | 72.2 | 28.37 | 67.08 |
| AD-62971.2 | Mm | 17.9 | 46.3 | 1.23 | 23.41 |
| AD-62972.2 | Mm | 75.6 | 122.9 | 24.75 | 18.00 |
| AD-62973.2 | Mm | 102.8 | 73.9 | 22.49 | 14.39 |

Example 3. In Vitro Single Dose Screen in Primary Mouse Hepatocytes

The modified and conjugated HAO1 siRNA duplexes were evaluated for efficacy by transfection assays in primary mouse hepatocytes. HAO1 siRNAs were transfected at two doses, 20 nM and 0.2 nM. The results of these assays are shown in Table 4 and the data are expressed as a fraction of the message remaining in cells transfected with siRNAs targeting HAO1, relative to cells transfected with a negative control siRNA, AD-1955±the standard deviation (SD).

TABLE 4a

HAO1 Single Dose Screen in Primary Mouse Hepatocytes.

| DUPLEX ID | Species | 20 nM PMH | 0.2 nM PMH | SD 20 nM PMH | SD 0.2 nM PMH |
|---|---|---|---|---|---|
| AD-62974 | Hs | 1.5 | 11.5 | 0.3 | 8.5 |
| AD-62975 | Hs | 6.2 | 24.5 | 1.9 | 19.4 |
| AD-62976 | Hs | 8.3 | 60.0 | 3.9 | 7.9 |
| AD-62977 | Hs | 69.1 | 106.9 | 44.8 | 18.3 |
| AD-62978 | Hs | 30.0 | 46.3 | 26.0 | 27.3 |
| AD-62979 | Hs | 50.7 | 59.5 | 45.6 | 43.4 |
| AD-62980 | Hs | 65.4 | 89.5 | 68.9 | 29.3 |
| AD-62981 | Hs | 65.8 | 83.3 | 31.9 | 23.7 |
| AD-62982 | Hs | 86.6 | 67.0 | 92.1 | 65.5 |
| AD-62983 | Hs | 81.5 | 103.6 | 61.3 | 68.0 |
| AD-62984 | Hs | 13.5 | 51.8 | 1.2 | 37.7 |
| AD-62985 | Hs | 53.8 | 37.7 | 38.1 | 26.3 |
| AD-62986 | Hs | 138.5 | 153.4 | 140.7 | 119.6 |
| AD-62987 | Hs | 39.0 | 99.6 | 44.9 | 110.7 |
| AD-62989 | Hs | 17.1 | 2.2 | 23.1 | 1.6 |
| AD-62990 | Hs | 4.3 | 46.3 | 4.6 | 46.4 |
| AD-62991 | Hs | 125.2 | 102.6 | 111.9 | 92.9 |
| AD-62992 | Hs | 64.7 | 65.6 | 67.8 | 55.8 |
| AD-62993 | Hs | 83.8 | 79.0 | 63.0 | 22.2 |
| AD-62994 | Hs | 1.9 | 5.4 | 1.5 | 0.2 |
| AD-62995 | Hs | 2.9 | 17.4 | 1.8 | 13.8 |
| AD-62996 | Hs | 49.3 | 61.4 | 43.6 | 49.9 |
| AD-62997 | Hs | 60.2 | 83.4 | 19.1 | 45.7 |
| AD-62998 | Hs | 73.5 | 86.7 | 71.5 | 69.4 |
| AD-62999 | Hs | 38.7 | 50.0 | 29.5 | 22.7 |
| AD-63000 | Hs | 27.3 | 56.6 | 26.1 | 41.4 |
| AD-63001 | Hs | 56.6 | 83.8 | 52.9 | 13.5 |
| AD-63002 | Hs | 81.6 | 74.2 | 67.4 | 70.5 |
| AD-63003 | Hs | 46.4 | 47.7 | 42.4 | 21.4 |
| AD-63004 | Hs | 28.6 | 64.5 | 17.0 | 44.5 |
| AD-62933 | Hs/Mm | 1.1 | 4.6 | 0.5 | 4.0 |
| AD-62934 | Hs/Mm | 7.6 | 43.4 | 0.6 | 32.6 |
| AD-62935 | Hs/Mm | 1.3 | 7.0 | 0.3 | 3.4 |
| AD-62939 | Hs/Mm | 6.1 | 21.4 | 2.2 | 14.5 |
| AD-62940 | Hs/Mm | 6.0 | 16.9 | 1.4 | 3.8 |
| AD-62941 | Hs/Mm | 5.6 | 8.5 | 3.9 | 6.3 |
| AD-62944 | Hs/Mm | 3.3 | 4.3 | 2.9 | 4.5 |
| AD-62945 | Hs/Mm | 6.4 | 7.0 | 1.0 | 7.2 |
| AD-62946 | Hs/Mm | 18.3 | 21.4 | 19.2 | 21.1 |
| AD-62949 | Hs/Mm | 11.4 | 43.7 | 8.9 | 38.3 |
| AD-62950 | Hs/Mm | 9.9 | 21.9 | 4.7 | 20.8 |
| AD-62954 | Hs/Mm | 9.4 | 65.5 | 0.2 | 64.3 |
| AD-62955 | Hs/Mm | 5.8 | 21.8 | 5.5 | 5.8 |
| AD-62959 | Hs/Mm | 4.2 | 9.6 | 1.8 | 5.3 |
| AD-62960 | Hs/Mm | 5.4 | 10.1 | 3.8 | 2.5 |
| AD-62964 | Hs/Mm | 3.7 | 21.2 | 0.9 | 12.7 |
| AD-62965 | Hs/Mm | 8.0 | 20.8 | 5.3 | 23.5 |
| AD-62969 | Hs/Mm | 6.4 | 4.7 | 3.8 | 5.1 |
| AD-62970 | Hs/Mm | 19.6 | 5.2 | 14.6 | 6.1 |
| AD-62936 | Mm | 7.0 | 17.5 | 0.1 | 9.9 |
| AD-62937 | Mm | 4.0 | 16.9 | 0.8 | 10.2 |
| AD-62938 | Mm | 4.0 | 49.1 | 0.7 | 42.4 |
| AD-62942 | Mm | 3.4 | 4.9 | 1.2 | 5.3 |
| AD-62943 | Mm | 3.8 | 14.9 | 2.2 | 10.6 |
| AD-62947 | Mm | 10.9 | 6.4 | 9.6 | 1.6 |
| AD-62948 | Mm | 6.7 | 18.7 | 6.9 | 15.8 |
| AD-62951 | Mm | 8.1 | 11.8 | 8.6 | 14.5 |
| AD-62952 | Mm | 9.4 | 23.2 | 10.1 | 29.2 |
| AD-62953 | Mm | 11.3 | 10.3 | 13.7 | 12.1 |
| AD-62956 | Mm | 2.2 | 3.9 | 1.8 | 1.6 |
| AD-62957 | Mm | 3.2 | 22.5 | 3.1 | 20.0 |
| AD-62958 | Mm | 7.5 | 16.0 | 5.8 | 13.2 |
| AD-62961 | Mm | 4.3 | 6.9 | 2.8 | 5.6 |
| AD-62962 | Mm | 17.1 | 42.4 | 14.2 | 49.5 |
| AD-62963 | Mm | 2.3 | 10.8 | 0.6 | 8.3 |
| AD-62966 | Mm | 5.7 | 11.6 | 5.8 | 5.6 |
| AD-62967 | Mm | 3.8 | 21.7 | 2.0 | 23.0 |
| AD-62968 | Mm | 3.5 | 9.4 | 0.3 | 9.0 |
| AD-62971 | Mm | 4.6 | 3.1 | 5.0 | 2.7 |
| AD-62972 | Mm | 13.8 | 22.7 | 17.0 | 24.9 |
| AD-62973 | Mm | 19.3 | 51.9 | 19.7 | 21.9 |

TABLE 4b

Additional HAO1 Single Dose Screen in Primary Mouse Hepatocytes.

| DUPLEX ID | Species | senseOligoName | 20 nM PMH | 0.2 nM PMH | SD 20 nM PMH | SD 0.2 nM PMH |
|---|---|---|---|---|---|---|
| AD-62974.2 | Hs | A-126176.1 | 1.5 | 11.5 | 0.3 | 8.5 |
| AD-62975.2 | Hs | A-126192.1 | 6.2 | 24.5 | 1.9 | 19.4 |
| AD-62976.2 | Hs | A-126208.1 | 8.3 | 60.0 | 3.9 | 7.9 |
| AD-62977.2 | Hs | A-126224.1 | 69.1 | 106.9 | 44.8 | 18.3 |
| AD-62978.2 | Hs | A-126178.1 | 30.0 | 46.3 | 26.0 | 27.3 |

TABLE 4b-continued

Additional HAO1 Single Dose Screen in Primary Mouse Hepatocytes.

| DUPLEX ID | Species | senseOligoName | 20 nM PMH | 0.2 nM PMH | SD 20 nM PMH | SD 0.2 nM PMH |
|---|---|---|---|---|---|---|
| AD-62979.2 | Hs | A-126194.1 | 50.7 | 59.5 | 45.6 | 43.4 |
| AD-62980.2 | Hs | A-126210.1 | 65.4 | 89.5 | 68.9 | 29.3 |
| AD-62981.2 | Hs | A-126226.1 | 65.8 | 83.3 | 31.9 | 23.7 |
| AD-62982.2 | Hs | A-126180.1 | 86.6 | 67.0 | 92.1 | 65.5 |
| AD-62983.2 | Hs | A-126196.1 | 81.5 | 103.6 | 61.3 | 68.0 |
| AD-62984.2 | Hs | A-126212.1 | 13.5 | 51.8 | 1.2 | 37.7 |
| AD-62985.2 | Hs | A-126228.1 | 53.8 | 37.7 | 38.1 | 26.3 |
| AD-62986.2 | Hs | A-126182.1 | 138.5 | 153.4 | 140.7 | 119.6 |
| AD-62987.2 | Hs | A-126198.1 | 39.0 | 99.6 | 44.9 | 110.7 |
| AD-62989.2 | Hs | A-126230.1 | 17.1 | 2.2 | 23.1 | 1.6 |
| AD-62990.2 | Hs | A-126184.1 | 4.3 | 46.3 | 4.6 | 46.4 |
| AD-62991.2 | Hs | A-126200.1 | 125.2 | 102.6 | 111.9 | 92.9 |
| AD-62992.2 | Hs | A-126216.1 | 64.7 | 65.6 | 67.8 | 55.8 |
| AD-62993.2 | Hs | A-126232.1 | 83.8 | 79.0 | 63.0 | 22.2 |
| AD-62994.2 | Hs | A-126186.1 | 1.9 | 5.4 | 1.5 | 0.2 |
| AD-62995.2 | Hs | A-126202.1 | 2.9 | 17.4 | 1.8 | 13.8 |
| AD-62996.2 | Hs | A-126218.1 | 49.3 | 61.4 | 43.6 | 49.9 |
| AD-62997.2 | Hs | A-126234.1 | 60.2 | 83.4 | 19.1 | 45.7 |
| AD-62998.2 | Hs | A-126188.1 | 73.5 | 86.7 | 71.5 | 69.4 |
| AD-62999.2 | Hs | A-126204.1 | 38.7 | 50.0 | 29.5 | 22.7 |
| AD-63000.2 | Hs | A-126220.1 | 27.3 | 56.6 | 26.1 | 41.4 |
| AD-63001.2 | Hs | A-126236.1 | 56.6 | 83.8 | 52.9 | 13.5 |
| AD-63002.2 | Hs | A-126190.1 | 81.6 | 74.2 | 67.4 | 70.5 |
| AD-63003.2 | Hs | A-126206.1 | 46.4 | 47.7 | 42.4 | 21.4 |
| AD-63004.2 | Hs | A-126222.1 | 28.6 | 64.5 | 17.0 | 44.5 |
| AD-62933.2 | Hs/Mm | A-126094.1 | 1.1 | 4.6 | 0.5 | 4.0 |
| AD-62934.2 | Hs/Mm | A-126110.1 | 7.6 | 43.4 | 0.6 | 32.6 |
| AD-62935.2 | Hs/Mm | A-126126.1 | 1.3 | 7.0 | 0.3 | 3.4 |
| AD-62939.2 | Hs/Mm | A-126096.1 | 6.1 | 21.4 | 2.2 | 14.5 |
| AD-62940.2 | Hs/Mm | A-126112.1 | 6.0 | 16.9 | 1.4 | 3.8 |
| AD-62941.2 | Hs/Mm | A-126128.1 | 5.6 | 8.5 | 3.9 | 5.3 |
| AD-62944.2 | Hs/Mm | A-126098.1 | 3.3 | 4.3 | 2.9 | 4.5 |
| AD-62945.2 | Hs/Mm | A-126114.1 | 6.4 | 7.0 | 1.0 | 7.2 |
| AD-62946.2 | Hs/Mm | A-126130.1 | 18.3 | 21.4 | 19.2 | 21.1 |
| AD-62949.2 | Hs/Mm | A-126100.1 | 11.4 | 43.7 | 8.9 | 38.3 |
| AD-62950.2 | Hs/Mm | A-126116.1 | 9.9 | 21.9 | 4.7 | 20.8 |
| AD-62954.2 | Hs/Mm | A-126102.1 | 9.4 | 65.5 | 0.2 | 64.3 |
| AD-62955.2 | Hs/Mm | A-126118.1 | 5.8 | 21.8 | 5.5 | 5.8 |
| AD-62959.2 | Hs/Mm | A-126104.1 | 4.2 | 9.6 | 1.8 | 5.3 |
| AD-62960.2 | Hs/Mm | A-126120.1 | 5.4 | 10.1 | 3.8 | 2.5 |
| AD-62964.2 | Hs/Mm | A-126106.1 | 3.7 | 21.2 | 0.9 | 12.7 |
| AD-62965.2 | Hs/Mm | A-126122.1 | 8.0 | 20.8 | 5.3 | 23.5 |
| AD-62969.2 | Hs/Mm | A-126108.1 | 6.4 | 4.7 | 3.8 | 5.1 |
| AD-62970.2 | Hs/Mm | A-126124.1 | 19.6 | 5.2 | 14.6 | 6.1 |
| AD-62936.2 | Mm | A-126142.1 | 7.0 | 17.5 | 0.1 | 9.9 |
| AD-62937.2 | Mm | A-126158.1 | 4.0 | 16.9 | 0.8 | 10.2 |
| AD-62938.2 | Mm | A-126174.1 | 4.0 | 49.1 | 0.7 | 42.4 |
| AD-62942.2 | Mm | A-126144.1 | 3.4 | 4.9 | 1.2 | 5.3 |
| AD-62943.2 | Mm | A-126160.1 | 3.8 | 14.9 | 2.2 | 10.6 |
| AD-62947.2 | Mm | A-126146.1 | 10.9 | 6.4 | 9.6 | 1.6 |
| AD-62948.2 | Mm | A-126162.1 | 6.7 | 18.7 | 6.9 | 15.8 |
| AD-62951.2 | Mm | A-126132.1 | 8.1 | 11.8 | 8.6 | 14.5 |
| AD-62952.2 | Mm | A-126148.1 | 9.4 | 23.2 | 10.1 | 29.2 |
| AD-62953.2 | Mm | A-126164.1 | 11.3 | 10.3 | 13.7 | 12.1 |
| AD-62956.2 | Mm | A-126134.1 | 2.2 | 3.9 | 1.8 | 1.6 |
| AD-62957.2 | Mm | A-126150.1 | 3.2 | 22.5 | 3.1 | 20.0 |
| AD-62958.2 | Mm | A-126166.1 | 7.5 | 16.0 | 5.8 | 13.2 |
| AD-62961.2 | Mm | A-126136.1 | 4.3 | 6.9 | 2.8 | 5.6 |
| AD-62962.2 | Mm | A-126152.1 | 17.1 | 42.4 | 14.2 | 49.5 |
| AD-62963.2 | Mm | A-126168.1 | 2.3 | 10.8 | 0.6 | 8.3 |
| AD-62966.2 | Mm | A-126138.1 | 5.7 | 11.6 | 5.8 | 5.6 |
| AD-62967.2 | Mm | A-126154.1 | 3.8 | 21.7 | 2.0 | 23.0 |
| AD-62968.2 | Mm | A-126170.1 | 3.5 | 9.4 | 0.3 | 9.0 |
| AD-62971.2 | Mm | A-126140.1 | 4.6 | 3.1 | 5.0 | 2.7 |
| AD-62972.2 | Mm | A-126156.1 | 13.8 | 22.7 | 17.0 | 24.9 |
| AD-62973.2 | Mm | A-126172.1 | 19.3 | 51.9 | 19.7 | 21.9 |

Example 4. Dose Response Screen in Primary Monkey Hepatocytes

The IC50s of modified and conjugated HAO1 siRNA duplexes were determined in primary monkey hepatocytes. HAO1 siRNAs were transfected over a range of doses from 10 nM to 36 fM final duplex concentration over 8, 6-fold dilutions. The results of these assays are shown in Table 5.

TABLE 5a

HAO1 Dose Response Screen in Primary Mouse Hepatocytes.

| DUPLEX ID | Species | IC50 PCH (nM) |
|---|---|---|
| AD-62984 | Hs | 0.017 |
| AD-62994 | Hs | 0.029 |
| AD-62989 | Hs | 0.175 |
| AD-62974 | Hs | 0.288 |
| AD-62975 | Hs | 0.399 |
| AD-62933 | Hs/Mm | 0.019 |
| AD-62944 | Hs/Mm | 0.027 |
| AD-62935 | Hs/Mm | 0.137 |
| AD-62965 | Hs/Mm | 0.155 |
| AD-62941 | Hs/Mm | 0.245 |
| AD-62940 | Hs/Mm | 0.927 |

TABLE 5b

Additional HAO1 Dose Response Screen in Primary Mouse Hepatocytes.

| DUPLEX ID | Species | IC50 PCH (nM) |
|---|---|---|
| AD-62984.2 | Hs | 0.017 |
| AD-62994.2 | Hs | 0.029 |
| AD-62989.2 | Hs | 0.175 |
| AD-62974.2 | Hs | 0.288 |
| AD-62975.2 | Hs | 0.399 |
| AD-62933.2 | Hs/Mm | 0.019 |
| AD-62944.2 | Hs/Mm | 0.027 |
| AD-62935.2 | Hs/Mm | 0.137 |
| AD-62965.2 | Hs/Mm | 0.155 |
| AD-62941.2 | Hs/Mm | 0.245 |
| AD-62940.2 | Hs/Mm | 0.927 |

Example 5. Dose Response Screen in Primary Mouse Hepatocytes

The IC50s of modified and conjugated HAO1 siRNA duplexes were determined in primary mouse hepatocytes. HAO1 siRNAs were transfected over a range of doses from 10 nM to 36 fM final duplex concentration over 8, 6-fold dilutions. The results of these assays are shown in Table 6.

TABLE 6a

HAO1 Dose Response Screen in Primary Mouse Hepatocytes.

| DUPLEX ID | Species | IC50 PMH (nM) |
|---|---|---|
| AD-62989 | Hs | 0.003 |
| AD-62994 | Hs | 0.006 |
| AD-62975 | Hs | 0.059 |
| AD-62974 | Hs | 0.122 |
| AD-62984 | Hs | 0.264 |
| AD-62944 | Hs/Mm | 0.002 |
| AD-62935 | Hs/Mm | 0.007 |
| AD-62965 | Hs/Mm | 0.008 |
| AD-62933 | Hs/Mm | 0.008 |
| AD-62941 | Hs/Mm | 0.087 |
| AD-62940 | Hs/Mm | 0.090 |

TABLE 6b

Additional HAO1 Dose Response Screen in Primary Mouse Hepatocytes.

| DUPLEX ID | Species | IC50 PMH (nM) |
|---|---|---|
| AD-62989.2 | Hs | 0.003 |
| AD-62994.2 | Hs | 0.006 |
| AD-62975.2 | Hs | 0.059 |
| AD-62974.2 | Hs | 0.122 |
| AD-62984.2 | Hs | 0.264 |
| AD-62944.2 | Hs/Mm | 0.002 |
| AD-62935.2 | Hs/Mm | 0.007 |
| AD-62965.2 | Hs/Mm | 0.008 |
| AD-62933.2 | Hs/Mm | 0.008 |
| AD-62941.2 | Hs/Mm | 0.087 |
| AD-62940.2 | Hs/Mm | 0.090 |

TABLE 7

Additional HAO1 Single Dose Screen in Primary Cyno and Mouse Hepatocytes

| Duplex ID | 10 nM PCH | 0.1 nM PCH | SD 10 nM PCH | SD 0.1 nM PCH | 10 nM PMH | 0.1 nM PMH | SD 10 nM PMH | SD 0.1 nM PMH |
|---|---|---|---|---|---|---|---|---|
| AD-62933.1 | 26.1 | 22.8 | 17.0 | 6.0 | 9.0 | 26.3 | 6.0 | 7.6 |
| AD-65584.1 | 12.9 | 28.0 | 5.1 | 6.0 | 3.8 | 12.3 | 0.7 | 7.3 |
| AD-65585.1 | 9.8 | 21.0 | 4.1 | 1.0 | 6.8 | 11.6 | 4.5 | 5.7 |
| AD-65586.1 | 24.3 | 24.2 | 10.9 | 2.7 | 16.7 | 19.0 | 5.1 | 1.8 |
| AD-65587.1 | 24.7 | 31.7 | 10.2 | 21.9 | 13.6 | 27.1 | 5.7 | 10.3 |
| AD-65588.1 | 39.2 | 33.0 | 35.6 | 5.6 | 27.1 | 33.5 | 11.0 | 8.3 |
| AD-65590.1 | 5.6 | 15.4 | 0.4 | 6.6 | 4.2 | 8.7 | 1.1 | 0.5 |
| AD-65591.1 | 13.9 | 20.4 | 5.0 | 4.9 | 7.6 | 18.4 | 0.1 | 2.9 |
| AD-65592.1 | 15.6 | 24.3 | 7.4 | 3.7 | 10.1 | 24.5 | 3.1 | 1.0 |
| AD-65593.1 | 30.8 | 37.5 | 4.4 | 8.7 | 38.4 | 41.3 | 5.2 | 10.4 |
| AD-65594.1 | 18.0 | 21.8 | 5.6 | 2.6 | 24.7 | 25.3 | 0.5 | 7.6 |
| AD-65595.1 | 19.9 | 31.9 | 0.1 | 11.3 | 9.1 | 12.2 | 5.0 | 5.7 |
| AD-65596.1 | 12.3 | 19.2 | 0.6 | 1.6 | 10.0 | 19.9 | 1.0 | 1.9 |
| AD-65597.1 | 10.2 | 34.8 | 2.8 | 10.1 | 22.8 | 32.0 | 6.2 | 5.7 |
| AD-65598.1 | 14.4 | 21.2 | 3.2 | 8.6 | 10.8 | 22.0 | 2.6 | 8.8 |
| AD-65599.1 | 15.0 | 28.3 | 2.5 | 21.3 | 18.0 | 25.4 | 1.7 | 8.3 |
| AD-65600.1 | 11.8 | 13.7 | 5.6 | 0.3 | 6.4 | 14.5 | 5.7 | 6.8 |
| AD-65601.1 | 15.4 | 20.5 | 0.5 | 1.6 | 5.5 | 17.2 | 0.3 | 3.9 |
| AD-65602.1 | 12.9 | 23.3 | 0.8 | 12.0 | 11.0 | 25.4 | 2.6 | 2.6 |
| AD-65603.1 | 33.8 | 41.0 | 2.2 | 6.8 | 37.4 | 58.6 | 3.0 | 10.5 |

TABLE 7-continued

Additional HAO1 Single Dose Screen in Primary Cyno and Mouse Hepatocytes

| Duplex ID | 10 nM PCH | 0.1 nM PCH | SD 10 nM PCH | SD 0.1 nM PCH | 10 nM PMH | 0.1 nM PMH | SD 10 nM PMH | SD 0.1 nM PMH |
|---|---|---|---|---|---|---|---|---|
| AD-65604.1 | 10.4 | 18.7 | 1.3 | 2.3 | 12.9 | 24.5 | 0.9 | 9.2 |
| AD-65606.1 | 14.3 | 12.3 | 0.2 | 3.1 | 4.8 | 14.0 | 2.0 | 4.2 |
| AD-65607.1 | 9.2 | 18.5 | 2.1 | 3.6 | 14.4 | 32.8 | 1.9 | 1.6 |
| AD-65608.1 | 36.6 | 31.1 | 7.9 | 11.6 | 27.5 | 29.8 | 8.5 | 4.6 |
| AD-65609.1 | 14.2 | 19.8 | 5.1 | 0.8 | 14.6 | 23.6 | 5.3 | 1.5 |
| AD-65610.1 | 59.1 | 59.6 | 15.0 | 13.3 | 35.0 | 70.9 | 10.0 | 0.1 |
| AD-65611.1 | 12.9 | 14.2 | 5.4 | 1.8 | 4.5 | 17.3 | 0.6 | 2.2 |
| AD-65612.1 | 19.3 | 20.5 | 1.5 | 9.0 | 16.2 | 23.3 | 3.8 | 1.7 |
| AD-65613.1 | 20.0 | 19.3 | 5.7 | 0.7 | 11.0 | 23.9 | 1.0 | 5.4 |
| AD-65614.1 | 12.4 | 27.1 | 2.2 | 0.5 | 14.2 | 16.7 | 3.8 | 11.9 |
| AD-65615.1 | 53.1 | 60.3 | 1.4 | 7.7 | 48.2 | 80.9 | 9.9 | 39.4 |
| AD-65616.1 | 21.7 | 12.5 | 17.8 | 5.5 | 5.3 | 13.3 | 0.5 | 7.2 |
| AD-65618.1 | 19.4 | 67.6 | 3.4 | 35.9 | 16.7 | 21.6 | 4.2 | 4.8 |
| AD-65619.1 | 17.0 | 27.2 | 0.5 | 12.4 | 12.5 | 26.3 | 3.2 | 2.3 |
| AD-65620.1 | 58.0 | 70.5 | 21.8 | 2.8 | 37.9 | 54.8 | 0.4 | 12.7 |
| AD-65621.1 | 12.3 | 17.5 | 4.6 | 2.3 | 3.8 | 11.3 | 1.3 | 0.3 |
| AD-65622.1 | 17.7 | 20.4 | 6.1 | 0.9 | 10.8 | 13.9 | 6.3 | 3.1 |
| AD-65623.1 | 44.4 | 32.9 | 7.9 | NA | 37.7 | 20.6 | 28.5 | 0.9 |
| AD-65624.1 | 13.0 | 23.3 | 5.0 | 9.8 | 9.2 | 7.9 | 2.8 | 0.4 |
| AD-65625.1 | 9.8 | 13.3 | 0.6 | 1.5 | 10.0 | 19.2 | 4.6 | 1.6 |
| AD-65626.1 | 7.7 | 15.0 | 1.1 | 4.9 | 8.6 | 14.7 | 3.6 | 2.4 |
| AD-65627.1 | 18.8 | 24.8 | 7.8 | 1.8 | 19.7 | 18.5 | 8.1 | 12.0 |
| AD-65628.1 | 27.3 | 31.7 | 4.9 | 3.9 | 29.7 | 43.4 | 6.4 | 19.6 |
| AD-65629.1 | 12.8 | 20.8 | 1.0 | 8.1 | 18.9 | 23.2 | 3.2 | 13.9 |
| AD-65630.1 | 7.2 | 14.0 | 0.3 | 5.3 | 6.1 | 8.5 | 1.3 | 2.1 |
| AD-65631.1 | 6.7 | 17.2 | 0.7 | 5.7 | 12.0 | 23.1 | 4.0 | 0.9 |
| AD-65633.1 | 13.8 | 28.6 | 3.4 | 5.4 | 17.0 | 26.2 | 1.2 | 3.9 |
| AD-65634.1 | 12.2 | 23.6 | 6.6 | 1.2 | 21.6 | 35.2 | 1.4 | 8.2 |
| AD-65635.1 | 11.7 | 27.7 | 5.7 | 4.7 | 18.5 | 38.4 | 2.5 | 6.5 |
| AD-65636.1 | 13.1 | 29.4 | 0.6 | 12.9 | 21.3 | 35.6 | 3.1 | 13.1 |
| AD-65637.1 | 16.0 | 22.8 | 5.1 | 9.6 | 8.3 | 18.5 | 0.6 | 0.4 |
| AD-65638.1 | 11.5 | 15.9 | 4.3 | 2.1 | 20.8 | 31.8 | 3.5 | 3.2 |
| AD-65639.1 | 14.6 | 28.3 | 7.4 | 5.5 | 18.6 | 35.2 | 0.2 | 0.3 |
| AD-65641.1 | 32.3 | 49.3 | 3.4 | 8.9 | 29.1 | 34.0 | 4.8 | 8.8 |
| AD-65642.1 | 10.4 | 23.0 | 0.1 | 4.7 | 10.1 | 21.3 | 1.0 | 6.5 |
| AD-65643.1 | 12.6 | 13.7 | 0.3 | 2.5 | 5.3 | 20.6 | 1.8 | 6.8 |
| AD-65644.1 | 8.1 | 13.5 | 0.1 | 0.3 | 16.4 | 24.1 | 3.4 | 4.2 |
| AD-65645.1 | 69.5 | 88.7 | 6.3 | 26.6 | 81.8 | 75.5 | 13.6 | 5.8 |
| AD-65646.1 | 8.9 | 47.0 | 0.9 | 15.6 | 26.5 | 37.7 | 3.7 | 4.7 |
| AD-65647.1 | 11.0 | 14.0 | 2.9 | 0.3 | 16.6 | 23.7 | 2.6 | 0.7 |
| AD-65648.1 | 7.3 | 25.4 | 3.3 | 2.9 | 5.9 | 13.9 | 2.1 | 0.9 |
| AD-65649.1 | 11.6 | 23.0 | 1.9 | 3.4 | 20.7 | 29.8 | 2.1 | 3.6 |
| AD-65650.1 | 27.9 | 40.6 | 13.1 | 14.0 | 27.6 | 30.6 | 9.7 | 6.8 |
| AD-65652.1 | 73.4 | 72.2 | 5.2 | 1.8 | 47.6 | 59.7 | 7.5 | 21.4 |
| AD-65653.1 | 9.6 | 32.4 | 2.7 | 4.7 | 5.9 | 24.3 | 0.0 | 6.7 |
| AD-65654.1 | 41.6 | 45.5 | 10.4 | 11.7 | 22.8 | 35.7 | 2.9 | 3.1 |
| AD-65655.1 | 19.2 | 18.3 | 0.1 | 4.8 | 17.8 | 18.8 | 3.8 | 3.9 |
| AD-65656.1 | 10.8 | 16.1 | 4.7 | 3.1 | 6.2 | 13.8 | 1.6 | 1.8 |
| AD-65657.1 | 107.8 | 114.5 | 8.7 | 6.7 | 36.3 | 51.2 | 1.6 | 14.1 |
| AD-65658.1 | 9.6 | 13.5 | 0.7 | 1.3 | 4.8 | 11.7 | 0.2 | 3.3 |
| AD-65659.1 | 17.5 | 39.8 | 1.1 | 1.4 | 13.0 | 24.6 | 3.5 | 3.3 |
| AD-65660.1 | 21.5 | 33.1 | 5.4 | 1.6 | 14.6 | 29.0 | 0.5 | 4.1 |
| AD-65661.1 | 13.9 | 40.1 | 2.2 | 12.8 | 13.2 | 27.3 | 6.8 | 7.1 |
| AD-65662.1 | 111.2 | 242.2 | 29.9 | 179.6 | 42.5 | 47.9 | 4.6 | 1.6 |
| AD-65663.1 | 11.5 | 28.2 | 3.8 | NA | 5.5 | 7.6 | 1.4 | 0.1 |
| AD-65665.1 | 104.8 | 141.7 | 13.0 | 26.9 | 39.4 | 44.2 | 13.1 | 5.3 |
| AD-65666.1 | 14.4 | 28.1 | 6.9 | 1.8 | 3.8 | 12.7 | 0.3 | 4.8 |

TABLE 8

Additional Single Dose Screen in Primary Cyno Hepatocytes.

| Duplex | 10 nM PCH | 10 nM PCH SD | 0.1 nM PCH | 0.1 nM {CH SD |
|---|---|---|---|---|
| AD-65626.5 | 7.1 | 0.7 | 23.5 | 3.7 |
| AD-68272.1 | 10.1 | 1.9 | 39.5 | 10.3 |
| AD-68273.1 | 6.8 | 2.2 | 29.7 | 10.1 |
| AD-68274.1 | 15.7 | 4.7 | 49.4 | 12.1 |
| AD-68275.1 | 15.5 | 2.7 | 47.4 | 10.4 |
| AD-68276.1 | 22.3 | 8.1 | 83.0 | 21.7 |
| AD-68277.1 | 14.2 | 1.1 | 25.2 | 7.9 |
| AD-68278.1 | 18.6 | 3.2 | 97.5 | 25.4 |
| AD-68279.1 | 14.7 | 3.8 | 62.5 | 19.6 |
| AD-68280.1 | 24.9 | 2.6 | 54.7 | 8.1 |

TABLE 8-continued

Additional Single Dose Screen in Primary Cyno Hepatocytes.

| Duplex | 10 nM PCH | 10 nM PCH SD | 0.1 nM PCH | 0.1 nM {CH SD |
|---|---|---|---|---|
| AD-68281.1 | 38.3 | 18.6 | 70.7 | 8.8 |
| AD-68282.1 | 11.3 | 3.1 | 35.9 | 3.6 |
| AD-68283.1 | 14.4 | 3.6 | 79.9 | 26.5 |
| AD-68284.1 | 25.1 | 4.7 | 82.3 | 8.2 |
| AD-68285.1 | 10.4 | 1.3 | 39.3 | 10.3 |
| AD-68286.1 | 14.7 | 4.5 | 71.9 | 18.3 |
| AD-68287.1 | 8.0 | 2.3 | 28.4 | 3.5 |
| AD-68288.1 | 14.8 | 3.5 | 31.7 | 6.3 |
| AD-68289.1 | 11.8 | 2.5 | 30.8 | 3.5 |
| AD-68290.1 | 11.5 | 4.9 | 40.3 | 8.4 |
| AD-68291.1 | 15.8 | 6.3 | 69.9 | 6.6 |
| AD-68292.1 | 9.8 | 3.0 | 37.3 | 20.7 |
| AD-68293.1 | 20.2 | 6.1 | 85.2 | 20.8 |
| AD-68294.1 | 12.9 | 5.0 | 68.7 | 21.6 |
| AD-68295.1 | 7.5 | 1.4 | 22.6 | 3.9 |
| AD-68296.1 | 8.5 | 1.1 | 51.3 | 7.0 |
| AD-68297.1 | 8.2 | 2.4 | 27.4 | 4.0 |
| AD-68298.1 | 10.1 | 2.8 | 35.6 | 10.4 |
| AD-68299.1 | 11.8 | 2.4 | 47.7 | 16.2 |
| AD-68300.1 | 7.2 | 1.7 | 33.8 | 4.6 |
| AD-68301.1 | 34.2 | 14.3 | 78.3 | 25.8 |
| AD-68302.1 | 15.6 | 5.8 | 57.1 | 10.0 |
| AD-68303.1 | 7.0 | 2.0 | 23.9 | 4.5 |
| AD-68304.1 | 14.8 | 2.4 | 64.2 | 12.1 |
| AD-68305.1 | 25.3 | 3.8 | 106.5 | 23.8 |
| AD-68306.1 | 12.4 | 2.0 | 19.8 | 1.8 |
| AD-68307.1 | 22.2 | 8.9 | 93.1 | 22.6 |
| AD-68308.1 | 22.2 | 4.0 | 79.6 | 7.8 |
| AD-68309.1 | 8.0 | 2.7 | 19.9 | 3.7 |

Example 6. In Vivo Evaluation of GO-GalNac Conjugates in C57B6 Mice

Figure 4B:
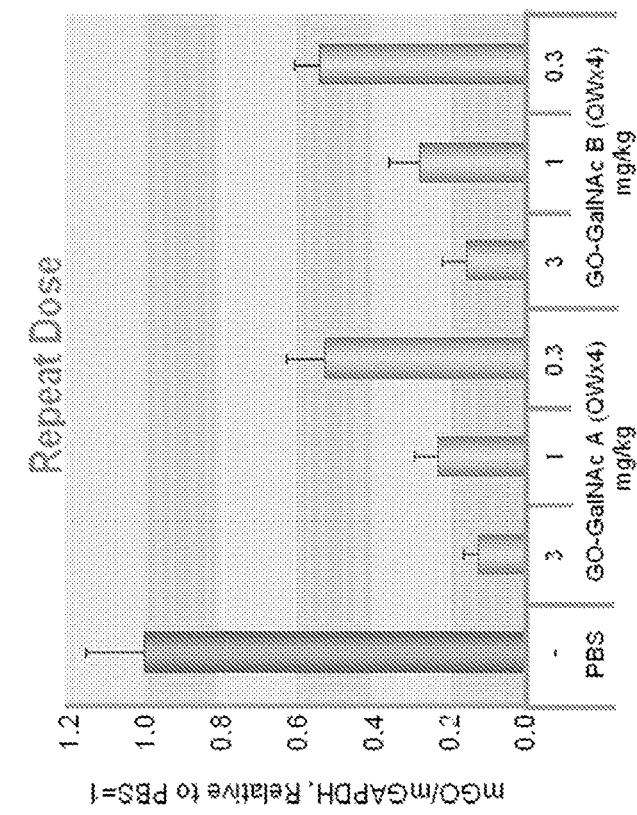
FIG. 4B is a graph with the results of in vivo evaluation of GO (HAO) GalNac-siRNA conjugates in C57B6 mice after a repeat dose.
Figure 4A:
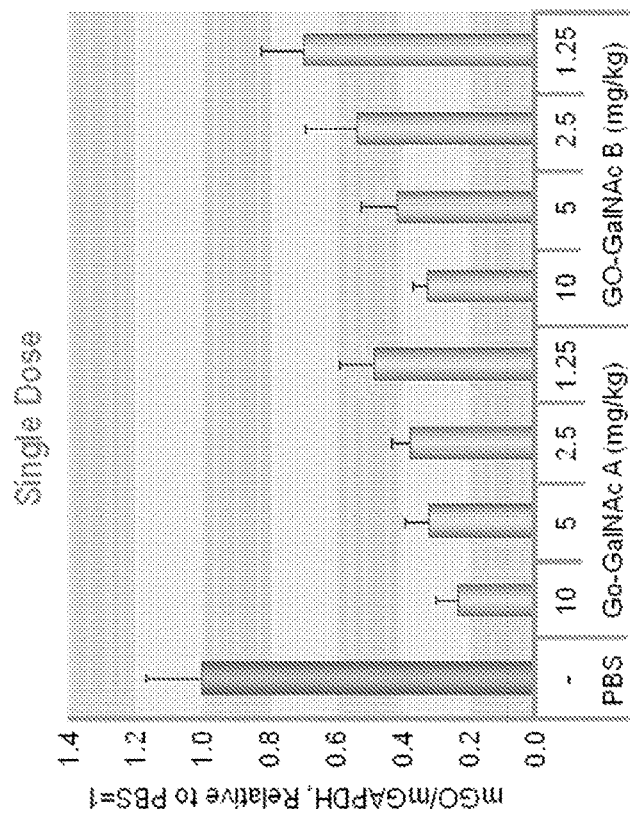
FIG. 4A is a graph with the results of in vivo evaluation of GO (HAO) GalNac-siRNA conjugates in C57B6 mice after a single dose.

GO-GalNAc conjugates were dosed subcutaneously in C57B6 mice at 10, 5, 2.5, or 1.25 mg/kg and mRNA knockdown in liver was evaluated after 72 hours post dose using qPCR. The single dose ED50s were approximately 1.25 and 2.5 mg/kg for compound A (AD-62994) and compound B (AD-62933) respectively. In repeat dose studies conjugates were dosed subcutaneously weekly (QW) for 4 weeks and liver GO mRNA levels were evaluated at 72 hours post the 4th dose. The repeat dose ED50s were ~0.3 mg/kg for both compounds. The results are shown in FIG. 4.

Figures 5A, 5B:
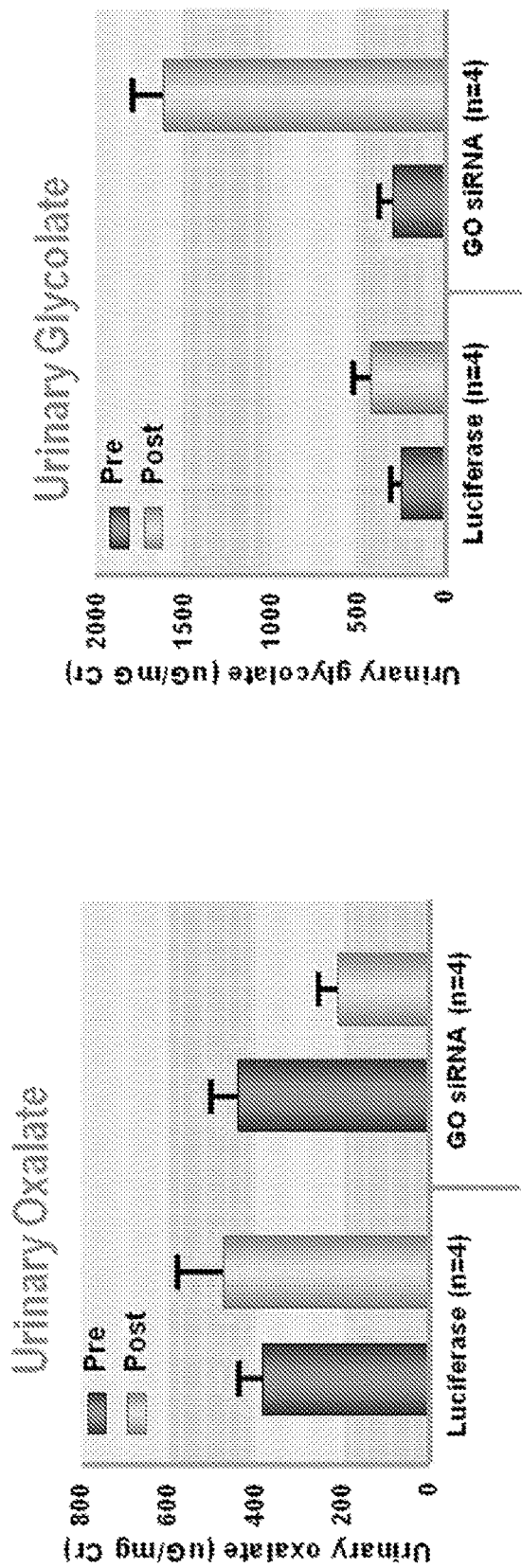
FIG. 5A is a graph showing urinary oxalate levels in AGXT knock out (KO) mice after treatment with GO (HAO) GalNac-siRNA conjugates.
FIG. 5B is a graph showing urinary glycolate levels in AGXT KO mice after treatment with GO (HAO) GalNac-siRNA conjugates.

Example 7. In Vive Evaluation of GO Knockdown and Impact on Oxalate Levels in AGXT KO Mice A GO siRNA (AD-40257) in a lipid nanoparticle (LNP) was dosed intravenously in AGXT KO mice (Salido et al (2006) PNAS 103:18249) at 1 mg/kg. Urinary oxalate or glycolate levels were measured on day 15 using ion chromatography/mass spectroscopy. The results are shown in FIG. 5. Data is expressed relative to pre dose values and was normalized to creatinine (Cr) to control for urine diluteness. N=4 mice per group and error bars represent standard deviation.

Figure 6B:
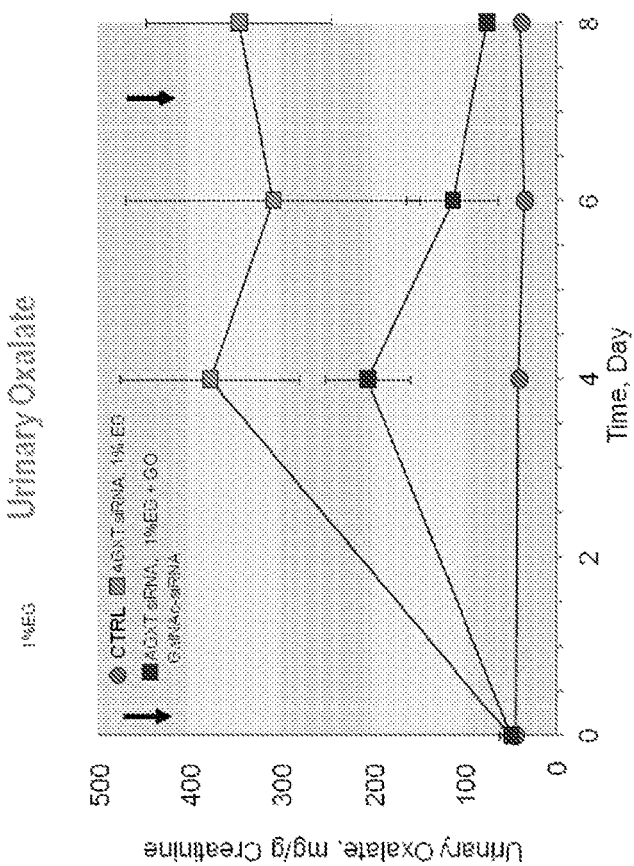
FIG. 6B is a graph showing urinary oxalate levels in a rat model of PH1 72 hours after treatment with a GO (HAO) GalNac-siRNA conjugate.
Figure 6A:
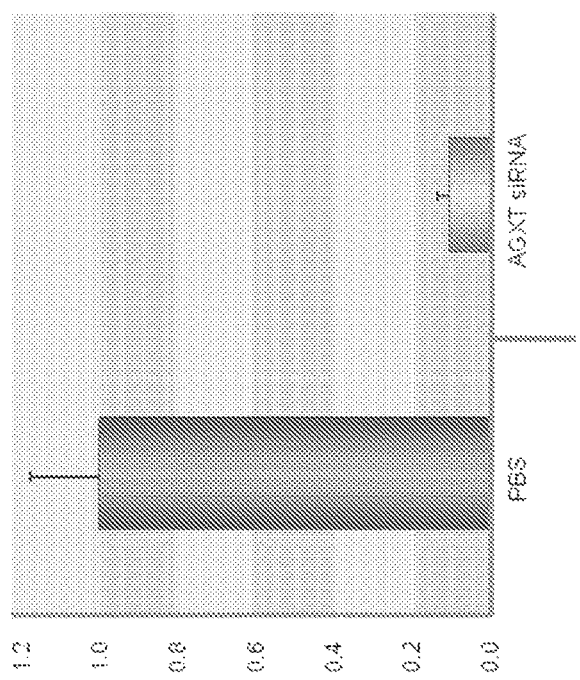
FIG. 6A is a graph showing AGXT mRNA levels in a rat model of PH1 72 hours after a single dose of an AGXT siRNA.
Figure 6C:
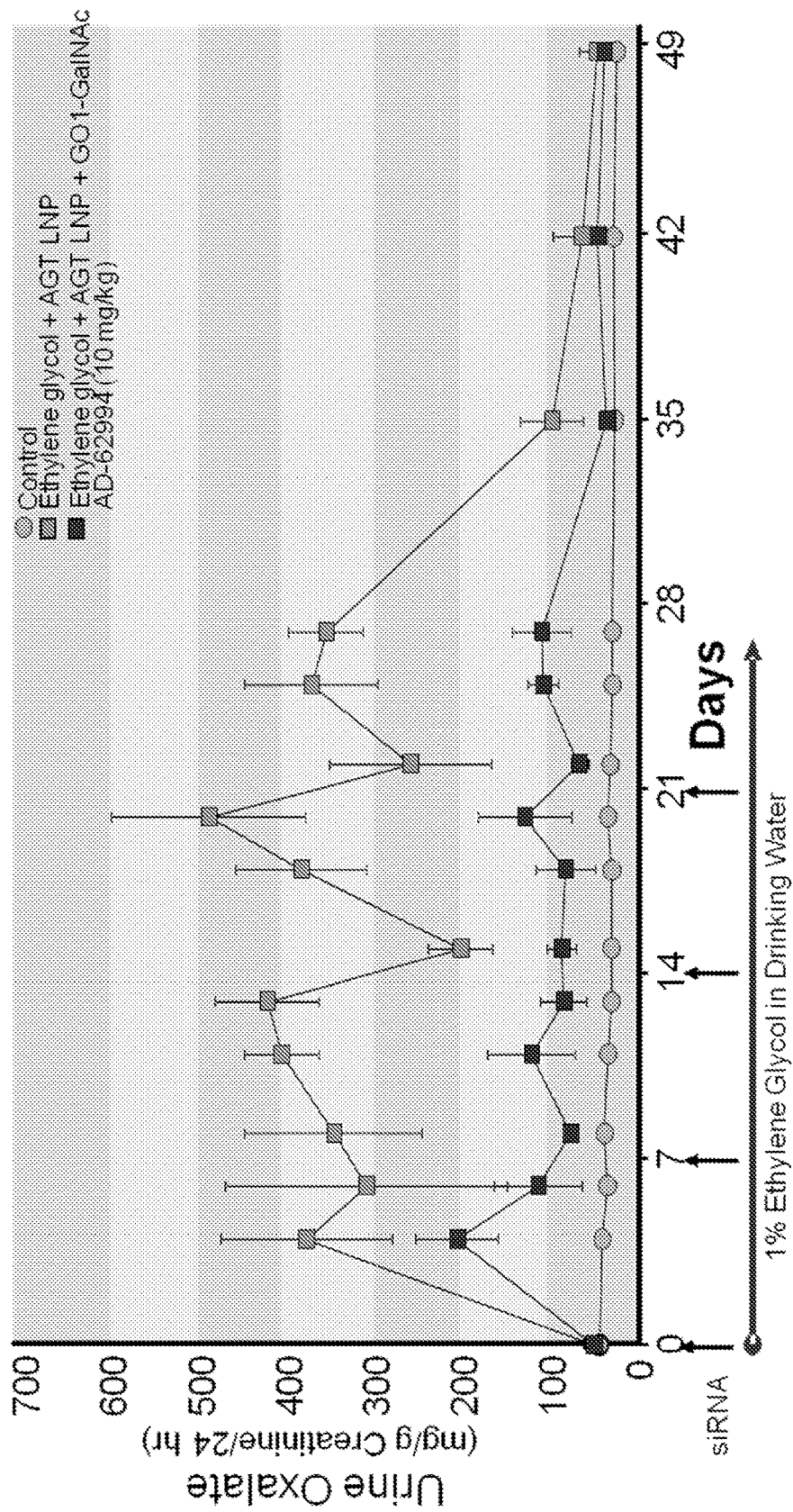
FIG. 6C is a graph showing urinary oxalate levels in a rat model of PH1 followed for 49 days with continued weekly dosing on days 14 and 21 of both AF-011-63102 and AD-62994 and 24 hour urine collections as shown.
Figure 6D:
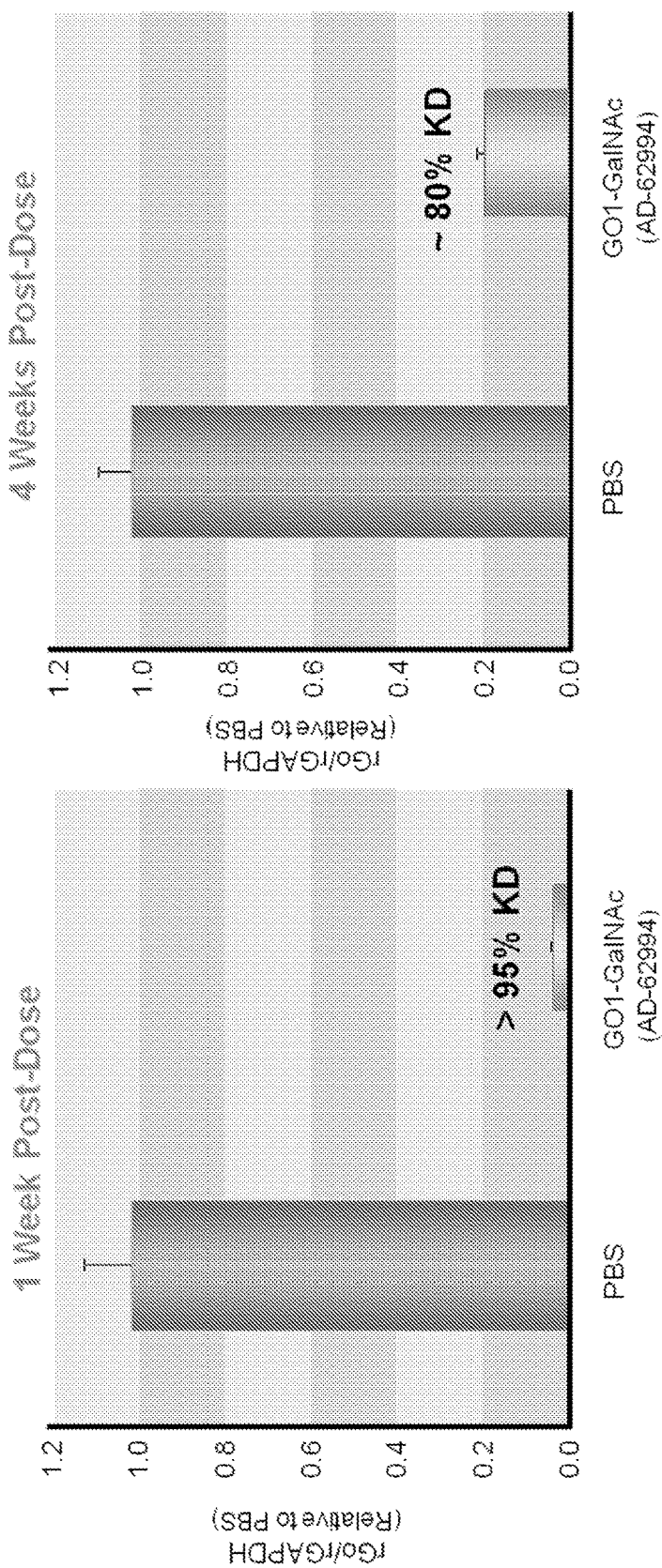
FIG. 6D is a graph showing duration of HAO1 knockdown in rats. Shown are mRNA levels either one week or four weeks after the last of 4 doses (corresponding to days 28 and 49 in FIG. 6C) and expressed relative to levels seen in rats treated with PBS

Example 8. In Vivo Evaluation of GO-GalNac Conjugates in a Rat AGXT Knockdown Model To generate a rat PH1 model, an AGXT siRNA (AD-63102) in an LNP (AF-011-63102) was dosed at 1 mg/kg intravenously to female Sprague Dawley rats on day 1 and day 7 to maintain knockdown of AGXT in rat liver and 1% Ethylene Glycol was added to the drinking water to further stimulate oxalate production. On day 0 and day 7 some rats were also dosed with a GO GalNAc-siRNA (AD-62994) conjugate or PBS control. The results are shown in FIG. 6. FIG. 6A shows quantitation of liver AGXT mRNA levels 72 hours after a single 1 mg/kg dose of AGXT siRNA in an LNP. In FIG. 6B, levels of urinary oxalate were quantified from 24 hour urines collected from day −1 to 0, day 3 to 4, day 5 to 6, and day 7 to 8. Data was normalized to creatinine to control for the diluteness of the urine. N=3 for AGXT groups and N=2 for PBS control group. In FIG. 6C, these same rats (as in FIG. 6B) were followed out to 49 days with continued weekly dosing on days 14 and 21 of both AF-011-63102 and AD-62994 and 24 hour urine collections as shown. Ethylene glycol remained in the drinking water until day 28. In FIG. 6D, duration of HAO knockdown in rats is shown by measuring mRNA levels either one week or four weeks after the last of 4 doses (corresponding to days 28 and 49 in FIG. 6C) and expressed relative to levels seen in rats treated with PBS. Error bars represent standard deviation throughout.

| duplexName | target | senseWksName |
|---|---|---|
| AD-40257.1 | HAO1 | NM_017545.2_1306-1324_s |
| AD-40257.2 | HAO1 | NM_017545.2_1306-1324_s |
| AD-63102.1 | AGXT | NM_016702.3_1109-1127_s |
| AD-63102.2 | AGXT | NM_016702.3_1109-1127_s |
| AD-63102.3 | AGXT | NM_016702.3_1109-1127_s |

| duplexName | Modified sense strand sequence | Unmodified sense strand sequence | SEQ ID NO: |
|---|---|---|---|
| AD-40257.1 | uucAAuGGGuGuccuAGGAdTsdT | UUCAAUGGGUGUCCUAGGA | 770 & 771 |
| AD-40257.2 | uucAAuGGGuGuccuAGGAdTsdT | UUCAAUGGGUGUCCUAGGA | 770 & 771 |
| AD-63102.1 | AcAAcuGGAGGGAcAucGudTsdT | ACAACUGGAGGGACAUCGU | 772 & 773 |
| AD-63102.2 | AcAAcuGGAGGGAcAucGudTsdT | ACAACUGGAGGGACAUCGU | 772 & 773 |
| AD-63102.3 | AcAAcuGGAGGGAcAucGudTsdT | ACAACUGGAGGGACAUCGU | 772 & 773 |

-continued

| duplexName | Modified antisense strand sequence | Unmodified antisense strand sequence | SEQ ID NO: |
|---|---|---|---|
| AD-40257.1 | UCCuAGGAcACCcAUUGAAdTsdT | UCCUAGGACACCCAUUGAA | 774 & 775 |
| AD-40257.2 | UCCuAGGAcACCcAUUGAAdTsdT | UCCUAGGACACCCAUUGAA | 774 & 775 |
| AD-63102.1 | ACGAUGUCCCUCcAGUUGUdTsdT | ACGAUGUCCCUCCAGUUGU | 776 & 777 |
| AD-63102.2 | ACGAUGUCCCUCcAGUUGUdTsdT | ACGAUGUCCCUCCAGUUGU | 776 & 777 |
| AD-63102.3 | ACGAUGUCCCUCcAGUUGUdTsdT | ACGAUGUCCCUCCAGUUGU | 776 & 777 |

Example 9: In Vivo Evaluation of GO-GalNac Conjugates

Figure 13:
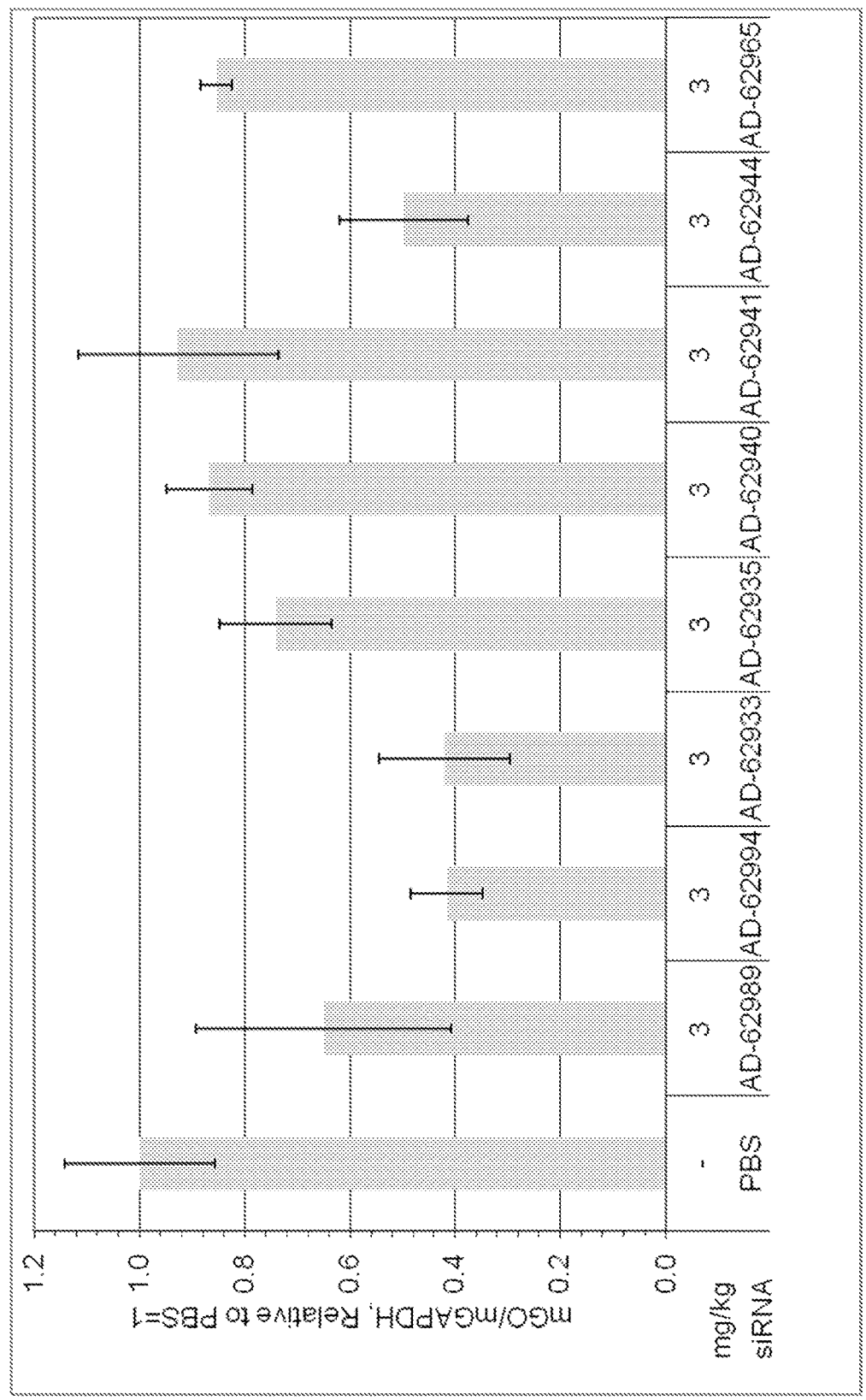
FIG. 13 shows in vivo screening of GO GalNAc conjugates.

Female C57BL/6 Mice, aged 6-8 weeks, were administered a single subcutaneous dose of the GO siRNA-GalNac conjugates in Table 7. The mice were sacrifices after 72 hours and the liver was assayed for HAO mRNA by bDNA analysis. The results are shown in FIG. 13.

TABLE 7

GO (HAO) siRNA-GalNac conjugates.

| duplexName | Modified sense strand sequence | SEQ ID NO: |
|---|---|---|
| AD-62989.2 | UfscsCfuAfgGfaAfCfCfuUfuUfaGfaAfaUfL96 | 778 |
| AD-62994.2 | GfsasCfuUfuCfaUfCfCfuGfaAfaAfuAfuAfL96 | 779 |
| AD-62933.2 | GfsasAfuGfuGfaAfAfGfuCfaUfcGfaCfaAfL96 | 780 |
| AD-62935.2 | CfsasUfuGfgUfgAfGfGfaAfaAfaUfcCfuUFL96 | 781 |
| AD-62940.2 | AfsusCfgAfcAfaGfAfCfaUfuGfgUfgAfgAfL96 | 782 |
| AD-62941.2 | AfscsAfuUfgGfuGfAfGfaAfaAfuCfcUfL96 | 783 |
| AD-62944.2 | GfsasAfaGfuCfaUfCfGfaCfaAfgAfcAfuUfL96 | 784 |
| AD-62965.2 | AfsasAfgUfcAfuCfGfAfcAfaGfaCfaUfuAfL96 | 785 |

| duplexName | Modified antisense strand | SEQ ID NO: |
|---|---|---|
| AD-62989.2 | asUfsuUfcUfaAfaAfgguUfcCfuAfgGfascsa | 786 |
| AD-62994.2 | usAfsuAfuUfuCfcAfggaUfgAfaAfgUfcscsa | 787 |
| AD-62933.2 | usUfsgUfcGfaUfgAfcuuUfcAfcAfuUfcsusg | 788 |
| AD-62935.2 | asAfsgGfaUfuUfuUfccuCfaCfcAfaUfgsusc | 789 |
| AD-62940.2 | usCfsuCfaCfcAfaUfgucUfuGfuCfgAfusgsa | 790 |
| AD-62941.2 | asGfsgAfuUfuUfuCfcucAfcCfaAfuGfuscsu | 791 |
| AD-62944.2 | asAfsuGfuCfuUfgUfcgaUfgAfcUfuUfcsasc | 792 |
| AD-62965.2 | usAfsaUfgUfcUfuGfucgAfuGfaCfuUfuscsa | 793 |

| duplexName | Crossreactivity | Guinea Pig? | MM to mouse | MM to GP |
|---|---|---|---|---|
| AD-62989.2 | Hs | yes | pos8 | |
| AD-62994.2 | Hs | no | pos16 | pos2,12,16 |
| AD-62933.2 | Hs/Mm | yes | | |
| AD-62935.2 | Hs/Mm | yes | | |
| AD-62940.2 | Hs/Mm | yes | | |
| AD-62941.2 | Hs/Mm | yes | | |

TABLE 7-continued

GO (HAO) siRNA-GalNac conjugates.

| | | |
|---|---|---|
| AD-62944.2 | Hs/Mm | yes |
| AD-62965.2 | Hs/Mm | yes |

Example 10: In Vivo Evaluation of GO-GalNAc Conjugates in Mice

Figure 14:
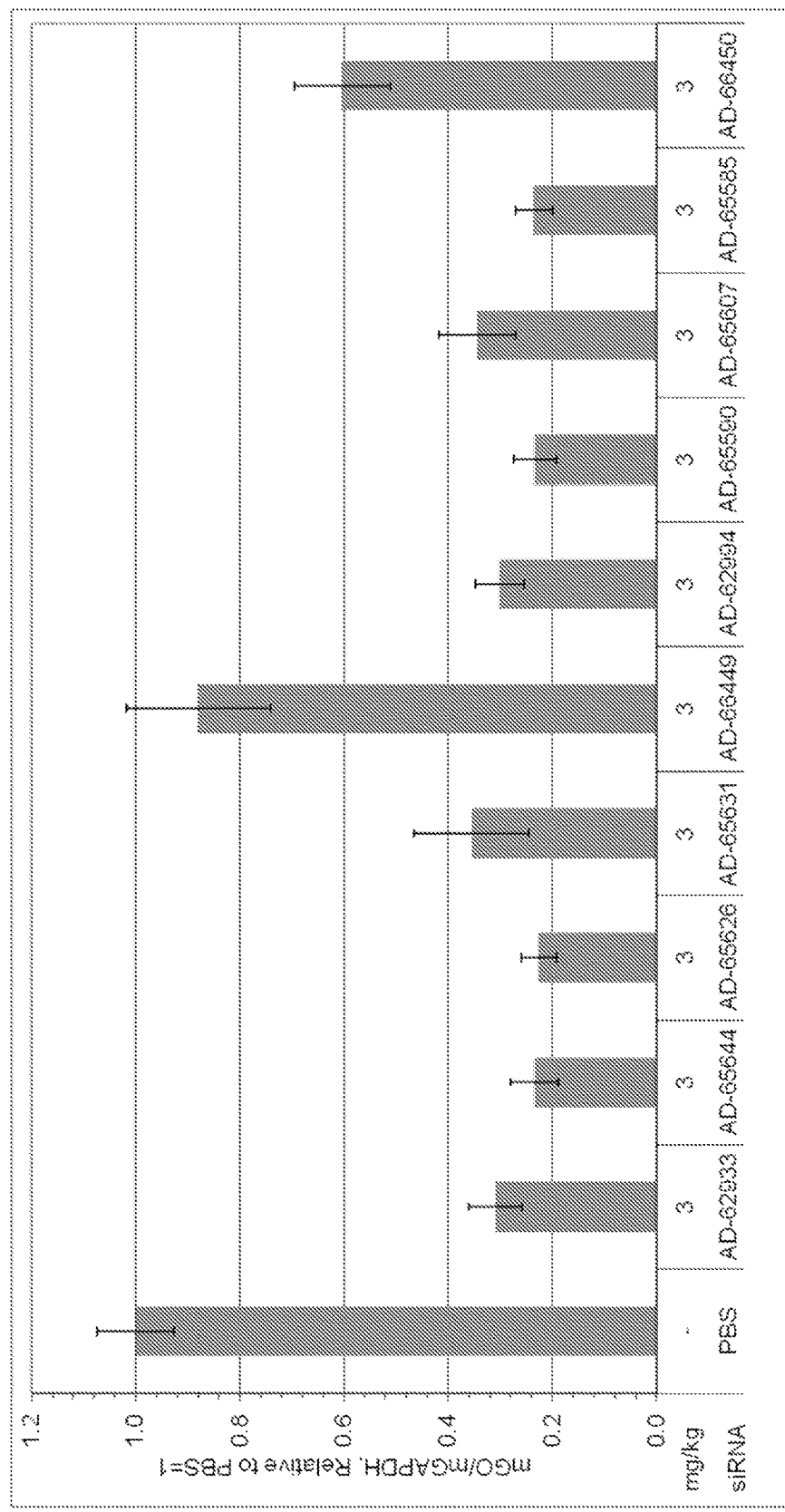
FIG. 14 is a graph showing an in vivo evaluation of GO-GalNAc conjugates in mice.

Female C57 BL/6 mice were administered a single subcutaneous 3 mg/Kg dose of the a number of GO siRNA-GalNAc conjugates described herein or PBS control. Mice were sacrificed after 72 hours and HAO1 mRNA knockdown in liver was evaluated using qPCR. The results are shown in FIG. 14, expressed relative to the PBS control.

Example 11: Dose-Response Evaluation of GO-GalNAc Conjugates in Mice

Figure 15:
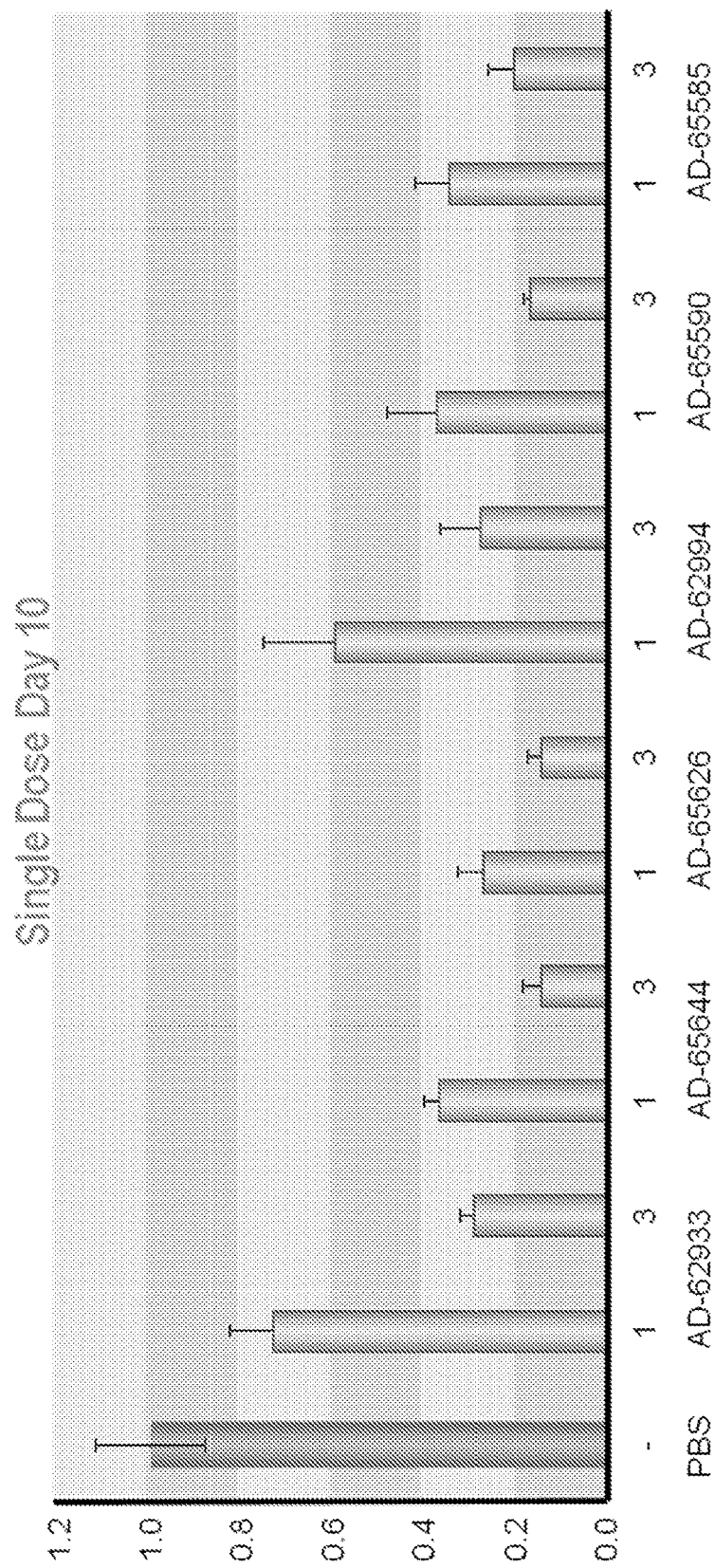
FIG. 15 is a graph showing a dose-response evaluation of GO-GalNAc conjugates in mice.
Figure 16:
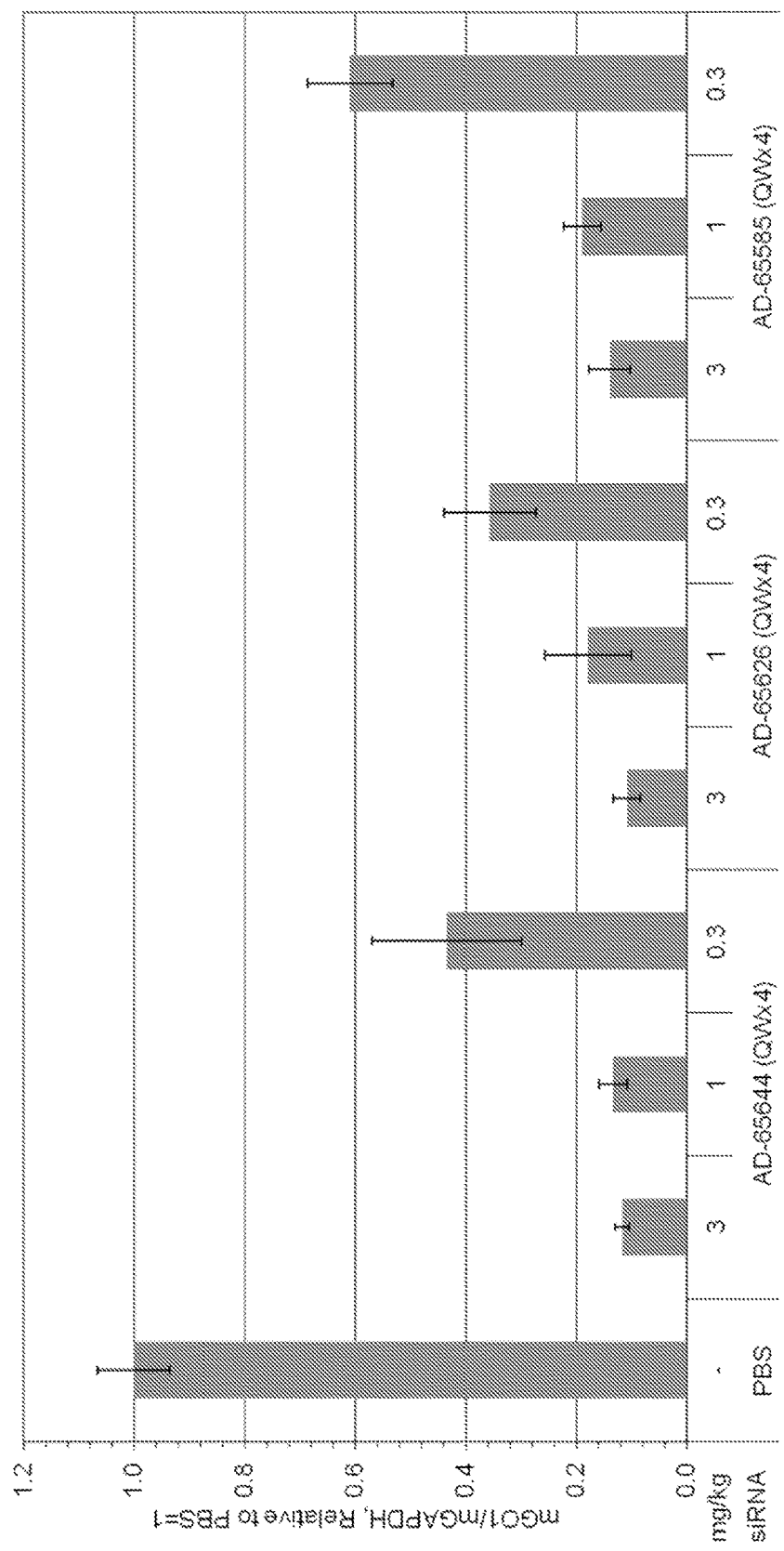
FIG. 16 is a graph showing a dose-response evaluation of GO-GalNAc conjugates in mice.

Female C57 BL/6 mice were administered a single subcutaneous dose of either 1 or 3 mg/Kg of one of the GO siRNA-GalNAc conjugates compound A (AD-62994), compound B (AD-62933), compound C (AD-65644), compound D (AD-65626), compound E (AD-65590), compound F (AD-65585) or PBS control. Ten days later mice were sacrificed and HAO1 mRNA knockdown in liver was evaluated using qPCR. In repeat dose studies, compounds C, D, F or PBS control were dosed subcutaneously weekly (QW) for 4 weeks and liver HAO1 mRNA levels were evaluated 10 days after the last dose. The results of single-dose are shown in FIG. 15 and repeat-dose experiments are shown in FIG. 16, expressed relative to the PBS control. These data showed improved potency for compounds AD-65644 and AD-65626 relative to AD-62933 and for compounds AD-65590 and AD-65585 relative to AD-62994.

Example 12: Dose-Response Evaluation of Compound D in Mice

Figure 17:
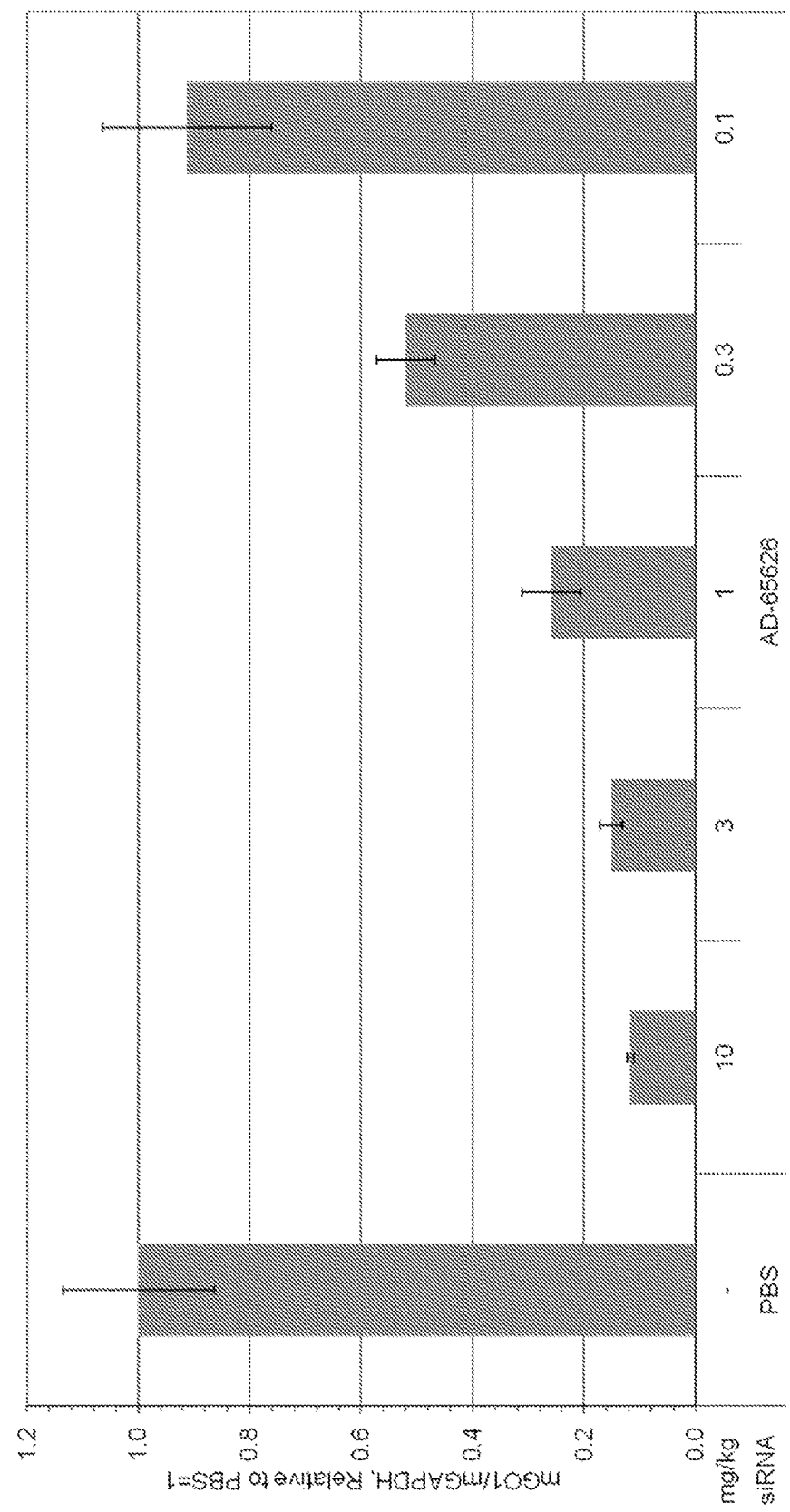
FIG. 17 is a graph showing a dose response evaluation in mice.

Female C57 BL/6 mice were administered a single subcutaneous dose of 0.1, 0.3, 1, 3, or 10 mg/Kg of AD-65626 or PBS control. Ten days later mice were sacrificed and HAO1 mRNA knockdown in liver was evaluated using qPCR with results expressed relative to the PBS control as shown in FIG. 17. These results demonstrate a greater than 3-fold improvement in potency compared to compound AD-62933.

Example 13: Relationship of mRNA Knockdown to Serum Glycolate Levels in Mice Female C57 BL/6 mice were administered a single subcutaneous dose of 0.1, 0.3, 1, 3, or 10 mg/Kg of AD-65585 or PBS control. Ten days later mice were sacrificed and HAO1 mRNA knockdown in liver was evaluated using qPCR, with results expressed relative to the PBS control. Glycolate levels in serum samples from these same mice were quantified using ion chromatography coupled to mass spectrometry as previously described (Knight et al., Anal. Biochem. 2012 Feb. 1; 421(1): 121-124). The results for these experiments are shown in FIG. 18.

These results demonstrate that AD-65585 is as potent as AD-65626, both having a single-dose ED50 of ~0.3 mg/kg in WT mice. Additionally, HAO1 mRNA silencing results in dose-responsive serum glycolate increases of up to 4-fold (approximately 200 uM) at the highest two doses.

Figure 19:
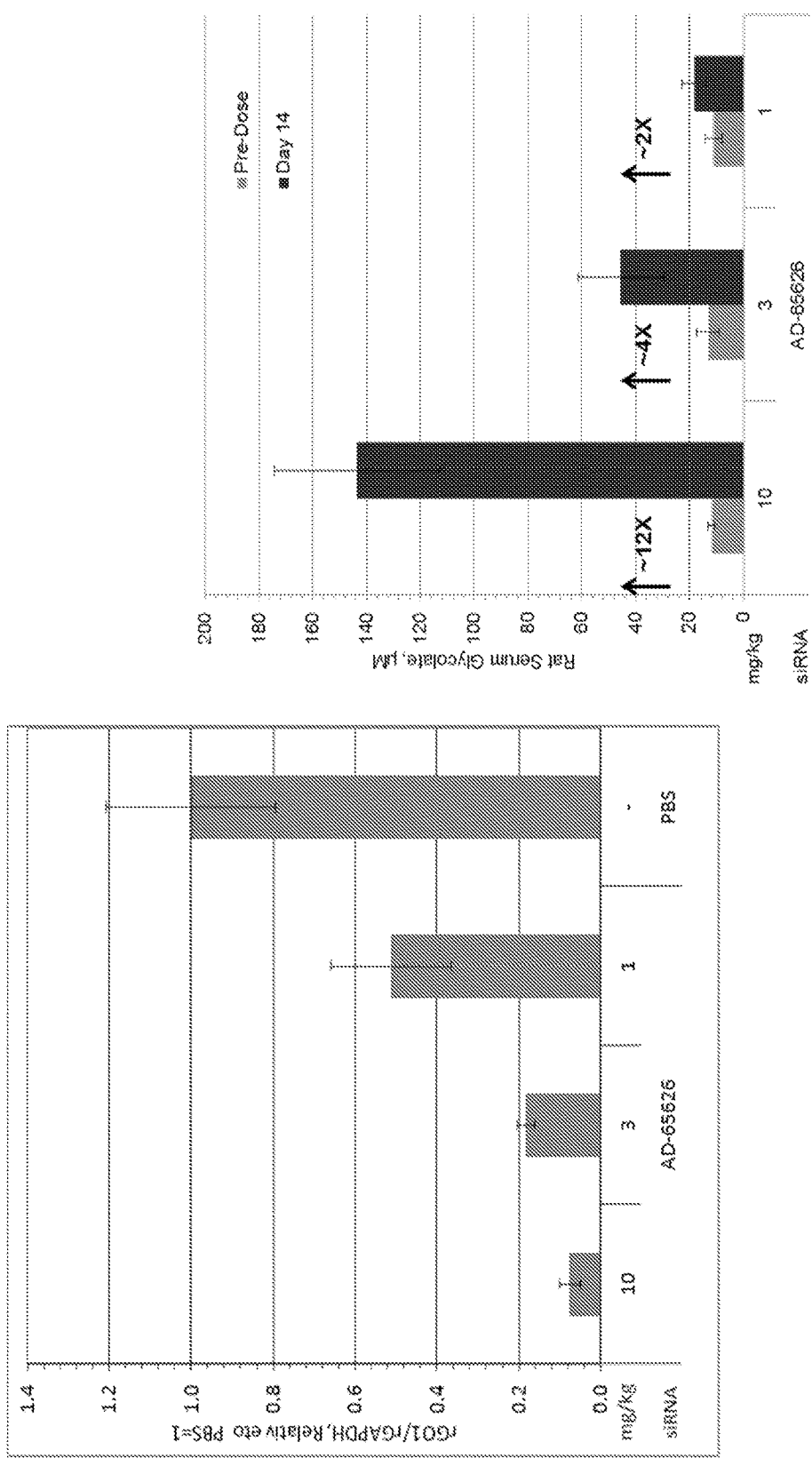
FIG. 19 is two graphs showing relationship of mRNA knockdown to serum glycolate levels in rats.

Example 14: Relationship of mRNA Knockdown to Serum Glycolate Levels in Rats Male Sprague Dawley rats were administered a single subcutaneous dose of 1, 3, or 10 mg/Kg of AD-65626 or PBS control. Fourteen days later rats were sacrificed and HAO1 mRNA knockdown in liver was evaluated using qPCR, with results expressed relative to the PBS control. Glycolate levels in serum samples from these same rats collected both prior to dosing and at day 14 were quantified using ion chromatography coupled to mass spectrometry, again as described (Knight et al., Anal. Biochem. 2012 Feb. 1; 421(1): 121-124). The results for these experiments are shown in FIG. 19.

As observed in wild-type mice, these results demonstrate that HAO1 mRNA silencing in Sprague Dawley rats results in dose-responsive serum glycolate increases of up to 12-fold (approximately 140 µM) at the highest dose.

Example 15: Pharmacology Studies with ALN-65585

HAO1 Inhibition in Hepatocytes.

Figure 20:
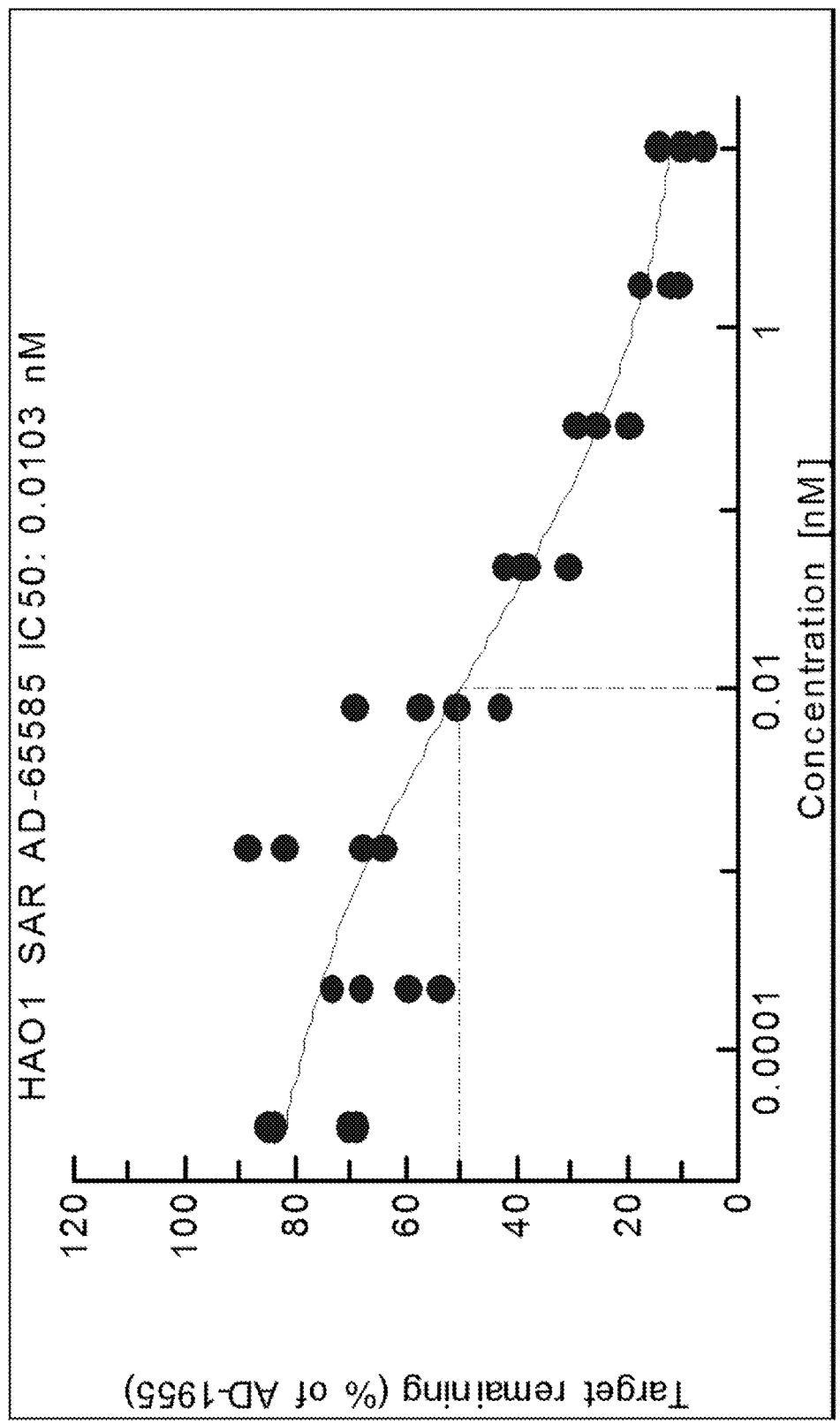
FIG. 20 is a graph showing dose dependent inhibition of HAO1 mRNA by ALN-65585 in primary cyno hepatocytes.

Primary cyno hepatocytes were transfected with RNAimax (Invitrogen) with serially diluted AD-65585 (ALN-65585, "ALN-GO1") or a non-targeting mRNA Luciferase control (AD 1955) at 10 nM. Relative levels of HAO1 mRNA were determined by normalizing to GAPDH mRNA levels as quantified by real-time RT-PCR. The data was plotted to calculate the IC50 value of 10 pM. The results are shown FIG. 20.

In vitro transfection of AD-65585 demonstrates an ED50 of approximately 10 pM in primary cynomolgus hepatocytes.

Single Dose Pharmacology in Mouse

ALN-GO1 pharmacology was evaluated in mice by quantifying liver HAO1 mRNA and serum glycolate levels (FIG. 21). A single SC dose of ALN-GO1 resulted in a dose dependent suppression of HAO1 mRNA with a dose of 10 mg/kg resulting in ED90 silencing. The ED50 dose for GO1 silencing in the mouse was estimated to be 0.3 mg/kg. Serum glycolate levels increased in a dose-responsive manner with a maximum level approximately 4-fold above baseline levels. The results are shown in FIG. 21, illustrating levels of liver HAO mRNA and serum glycolate 10 days after a single subcutaneous dose of ΔLN-65585 in C57BL16 mice. Bars represent the mean of 3 or 4 animals and error bars depict the standard deviation.

Single Dose Duration in Mouse

Figure 22:
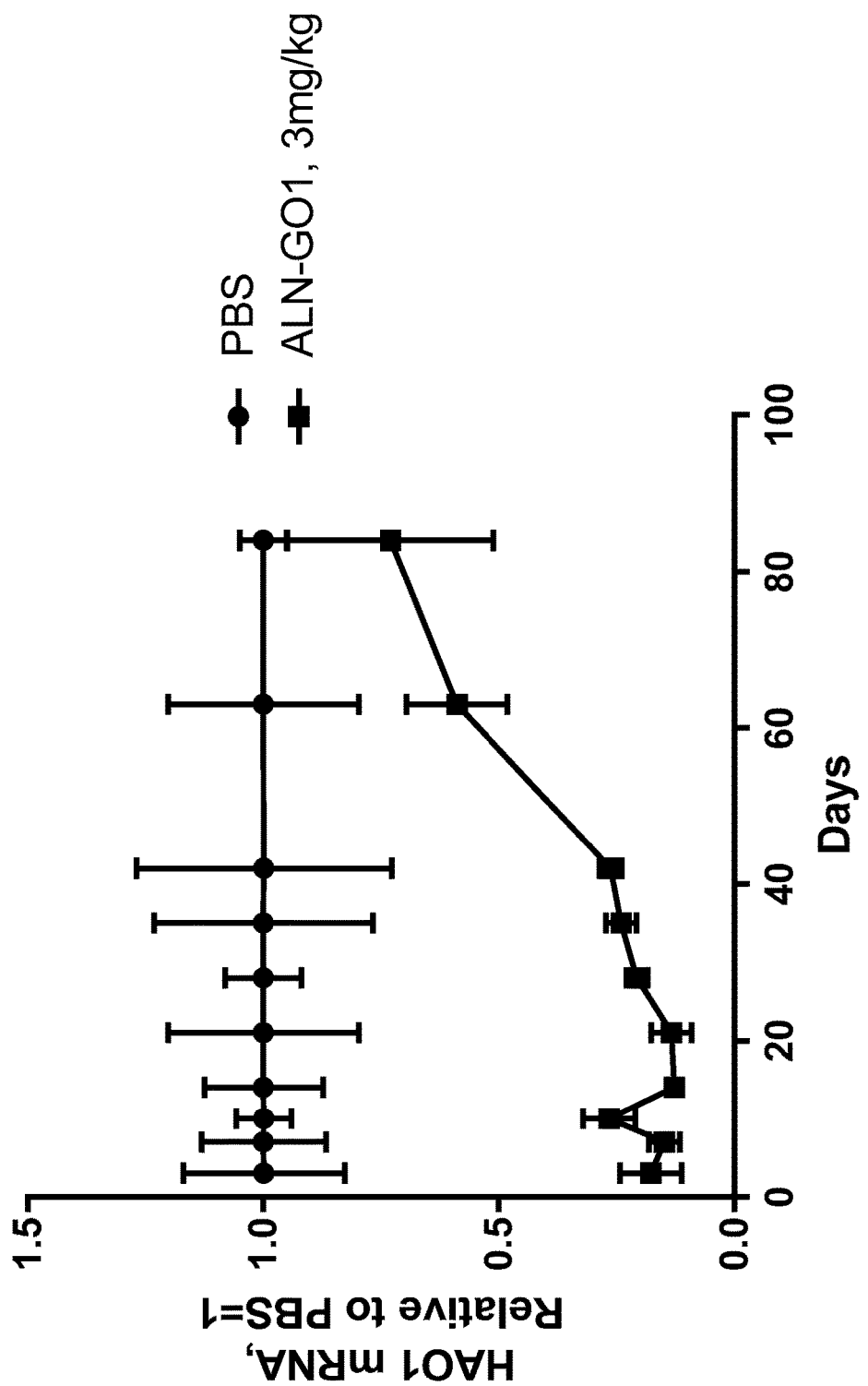
FIG. 22 is a graph showing duration of HAO1 mRNA silencing following single dose treatment with ALN-GO1 in mice.

GO1 silencing was durable and reversible post a single SC dose (FIG. 22). A single SC dose of ALN-GO1 in mice at 3 mg/kg resulted in ≥70% mRNA silencing for approximately 6 weeks, after which mRNA levels recovered to baseline levels through 12 weeks post-dose. The results are shown in FIG. 22: Levels of liver HAO1 mRNA at multiple time points following a single subcutaneous dose of ALN- 65585 in C57BL/6 mice. Each data point represents the mean of 3 animals and error bars depict the standard deviation.

Single Dose Pharmacology in Rat

Figure 23:
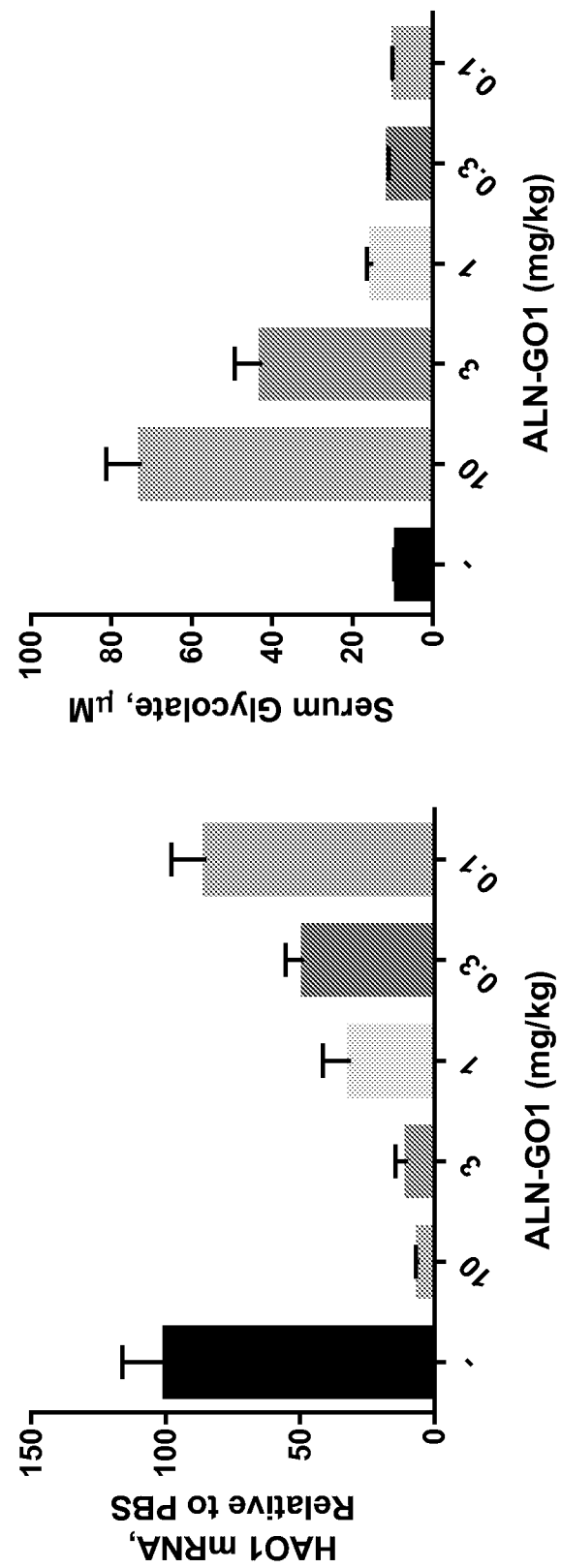
FIG. 23 is a graph showing HAO1 mRNA and serum glycolate levels following single dose treatment with ALN-GO1 in rats.

ALN-GO1 pharmacology was also evaluated in rats by quantifying liver HAO1 mRNA levels (FIG. 23). A single SC administration of ALN-GO1 to male Sprague Dawley rats resulted in a dose dependent suppression of HAO1 mRNA with a dose of ≥3 mg/kg resulting in ED90 silencing. The results are shown in FIG. 23: Levels of liver HAO1 mRNA 10 days after a single subcutaneous dose of ALN-65585 in Sprague Dawley rats. Bars represent the mean of 3 animals and error bars depict the standard deviation. The ED50 dose for GO1 silencing in the rat was estimated to be 0.3 mg/kg.

Single Dose Pharmacology in AGXT KO Mouse

Figure 24:
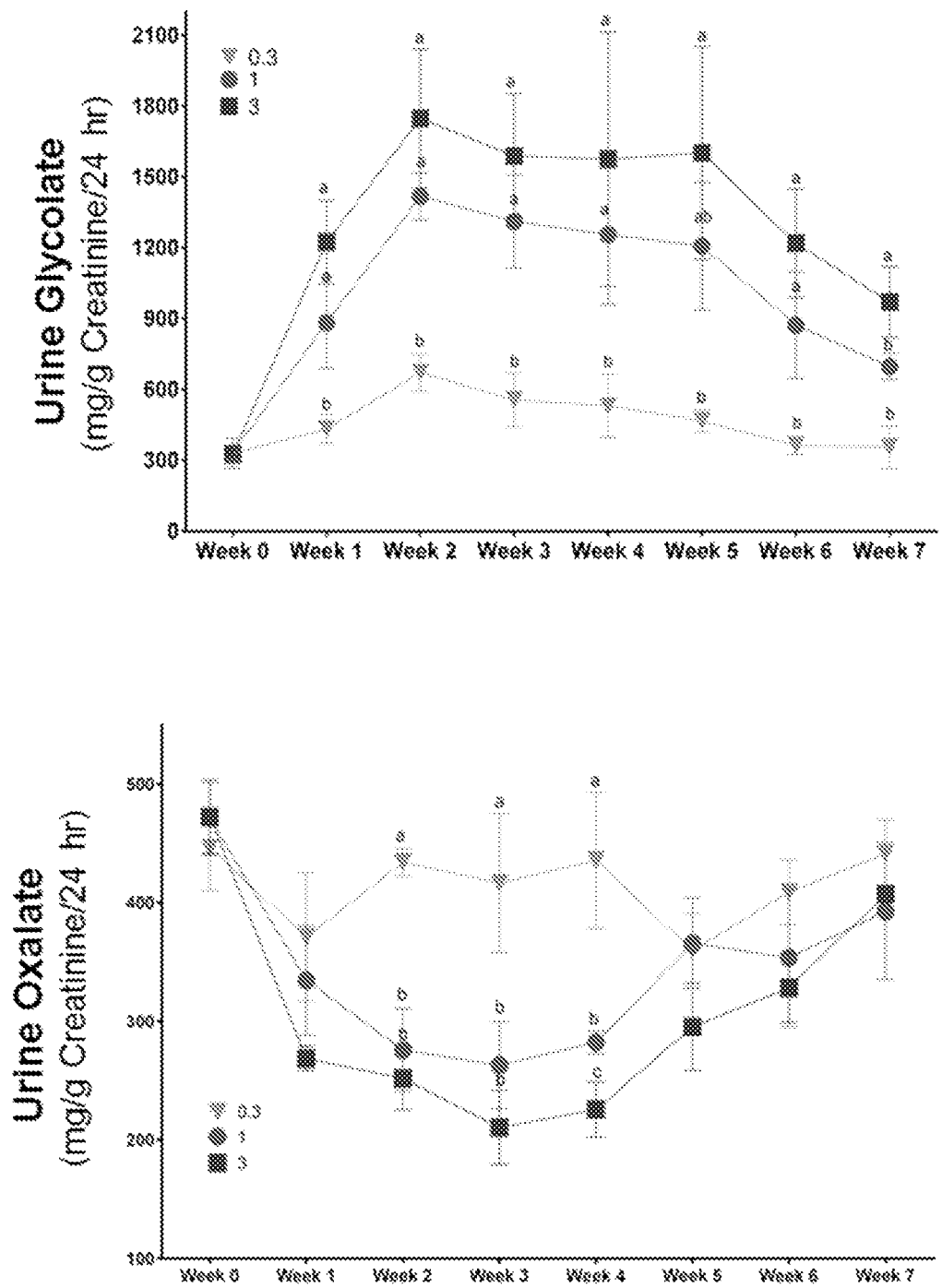
FIG. 24 is two graphs showing urinary oxalate and glycolate levels in a mouse model of primary hyperoxaluria type I after a single dose of ALN-GO1.

The impact of ALN-GO1 on oxalate levels was evaluated in an AGXT KO mouse model of PH1. The results are shown in FIG. 24: 24 hr urinary oxalate (top) and glycolate (bottom) excretion of Agxt KO mice after a single subcutaneous dose of ALN-65585. Different letters means significant difference between the 3 dose groups at each specific week (n=3 per dose). Urinary excretions over time did not change significantly in the PBS control animal (n=1).

Urinary oxalate levels showed dose-dependent reductions after a single dose of ALN-GO1 with a maximum of approximately 50% oxalate lowering at the 3 mg/kg dose that lasted for ≥3 weeks before recovery to pre-dose levels. Urinary glycolate levels showed dose-dependent increases after a single dose of ALN-GO1 with a maximum of approximately 5-fold increases at the 3 mg/kg dose that lasted for ≥4 weeks.

Single Dose Pharmacology in PH1 Induced Rat Model

Figure 25B:
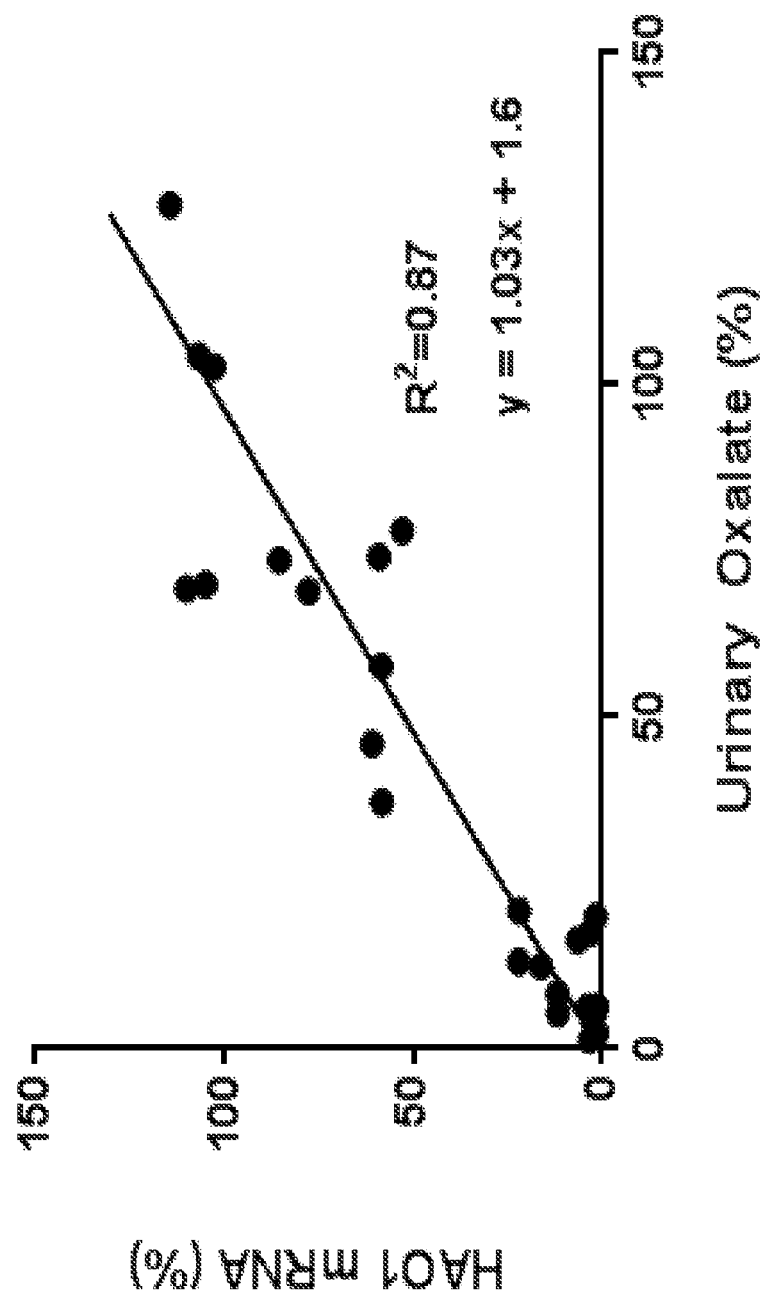
FIG. 25B is a graph showing urinary oxalate levels in a rat model of primary hyperoxaluria type i after a single dose of ALN-GO1.

ALN-GO1 was evaluated in a second PH1 rodent model where liver AGXT was inhibited in rats using siRNA and oxalate levels were stimulated with ethylene glycol (FIG. 25A and FIG. 25B). Liver HAO1 mRNA and 24-hour urinary oxalate were quantified to determine the degree of HAO1 lowering required for maximal oxalate reduction. The results are shown in FIG. 25A and FIG. 25B: Levels of liver HAO1 mRNA a rat induced model of PH1 14 days after a single subcutaneous dose of ALN-65585 and weekly dosing of AF-011-AGXT siRNA (2 doses, of 1 mg/kg). 24 hr urinary oxalate normalized to urinary creatinine. Bars represent the mean of 3 animals and error bars depict the standard deviation. mRNA and oxalate lowering correlation plot represents individual animals from multiple experiments.

A single dose of ALN-GO1 in this model demonstrated dose-responsive mRNA and urinary oxalate lowering with approximately 85% maximum mRNA reduction and approximately 90% maximum urinary oxalate reduction observed at the highest dose of ALN-GO1 (FIG. 25A and FIG. 25B). In this induced rat model of PH1. mRNA and urinary oxalate reductions resulted in a 1:1 correlation.

Multi-Dose Pharmacology in PH1 Induced Rat Model

Figure 26:
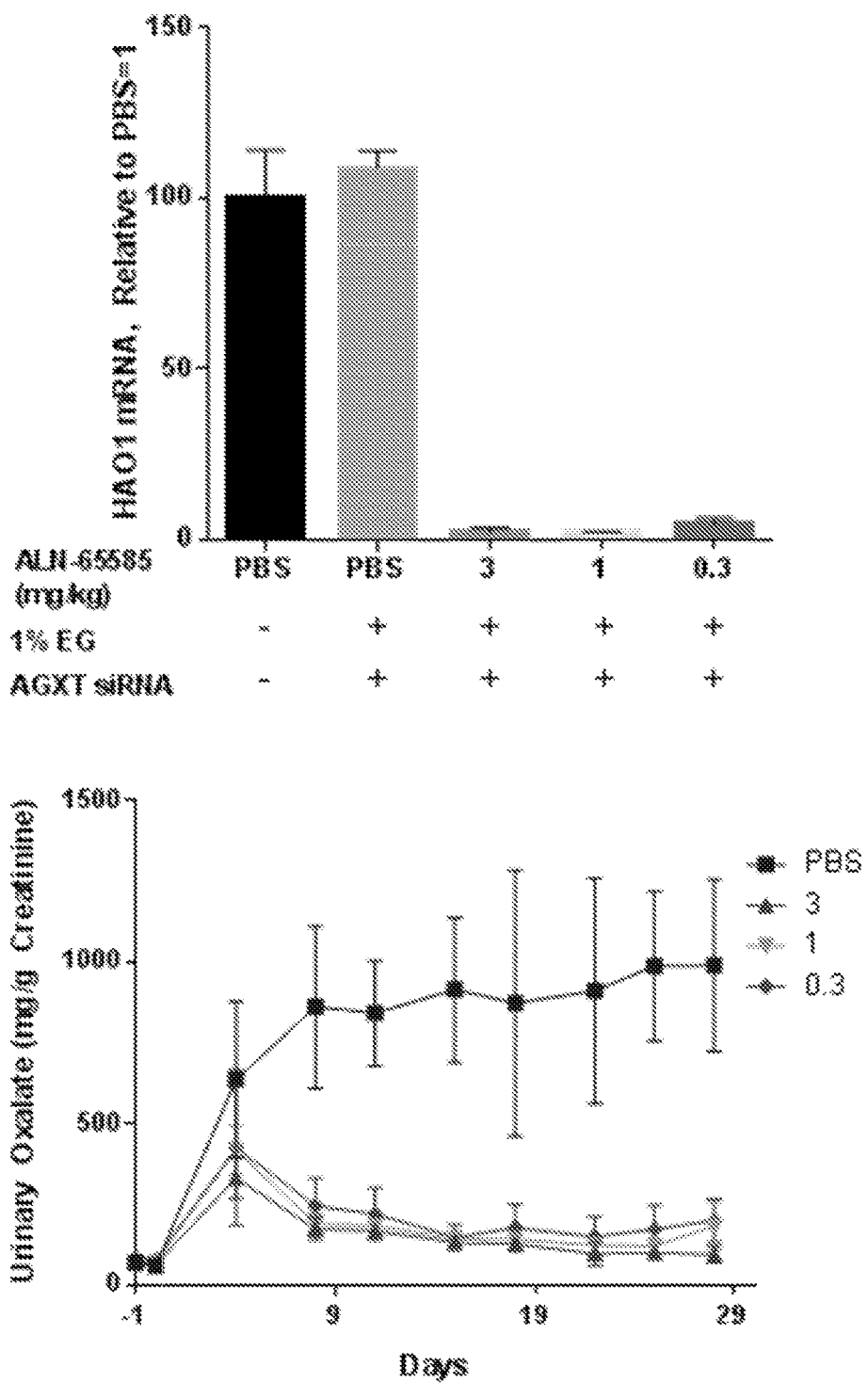
FIG. 26 is two graphs showing HAO1 mRNA and urinary oxalate levels in a rat model of primary hyperoxaluria type I after repeat dosing of ALN-GO1.

Potency of ALN-GO1 was evaluated in studies in normal rats with inhibited AGXT activity and ethylene glycol (an induced model of PH1) by quantifying liver HAO1 mRNA and 24-hour urinary oxalate. The results are shown in FIG. 26: Levels of liver HAO1 mRNA a rat induced model of PH1 28 days after repeat subcutaneous dosing of ALN-65585 and repeat IV dosing of AF-011 I-AGXT siRNA (4 doses, of 1 mg/kg). 24 hr urinary oxalate normalized to urinary creatinine. Bars represent the mean of 2 or 3 animals and error bars depict the standard deviation.

Treatment with ALN-GO1 resulted in sustained urinary oxalate reductions in all treatment groups for approximately 3 weeks. On day 28 after repeat dosing of ALN-GO1 (and four doses of AF-011-AGXT) all groups showed >95% mRNA reduction >85% urinary oxalate lowering.

Multi-Dose Pharmacology in NHP

ALN-GO1 pharmacology was evaluated in cynomolgus monkeys (non-human primate (NHP)) by quantifying HAO1 mRNA in liver biopsy, and serum glycolate levels. The following table shows the NHP Pharmacology study outline detailing dose level and dose regimen.

| Group # | Test Article | Dose level (mg/kg) | Dose frequency |
|---|---|---|---|
| 1 | PBS | Na | QM x 6 |
| 2 | AD-65585 | 0.25 | QM x 8 |
| 3 | AD-65585 | 1 | QM x 8 |
| 4 | AD-65585 | 1 | QM x 6 |
| 5 | AD-65585 | 2 | QM x 6 |
| 6 | AD-65585 | 4 | QM x 6 |
| 7 | AD-65585 | 2 -> 1 | QM x 4 -> QM x 5 |

The results are shown in FIG. 27. NHP serum glycolate levels for all groups out to day 85, data represents group averages of 3 animals per group, lines represent standard deviation. Liver biopsy HAO1 mRNA on Day 29, lines represent group averages, symbols represent individual animal mRNA levels relative to PBS control on Day 29.

After the first month of dosing (day 29), dose-responsive mRNA silencing was observed in all groups, with up to 99% mRNA silencing in groups 6 and 7 dosed with 4 mg/kg monthly or 2 mg/kg weekly. Maximum elevated serum glycolate levels of approximately 70 μM were maintained for at least 3 weeks in group 6 dosed with 4 mg/kg monthly. Intermediate Serum Glycolate Example 16: Additional sIRNA Sequences Additional siRNA design was carried out to identify siRNAs targeting HAO1 NM_017545.2.

| Unmodified sequence | SEQ ID NO: | Modified sequence | SEQ ID NO: | strand | Length |
|---|---|---|---|---|---|
| AUGUAUGUUACUUCUUAGAGA | 794 | asusguauGfuUfAfCfuucuuagagaL96 | 1890 | sense | 21 |
| UCUCUAAGAAGUAACAUACAUCC | 795 | usCfsucuAfaGfAfaguaAfcAfuacauscsc | 1891 | antis | 23 |
| UGUAUGUUACUUCUUAGAGAG | 796 | usgsuaugUfuAfCfUfucuuagagagL96 | 1892 | sense | 21 |
| CUCUCUAAGAAGUAACAUACAUC | 797 | csUfscucUfaAfGfaaguAfaCfauacasusc | 1893 | antis | 23 |
| UAGGAUGUAUGUUACUUCUUA | 798 | usasggauGfuAfUfGfuuacuucuuaL96 | 1894 | sense | 21 |
| UAAGAAGUAACAUACAUCCUAAA | 799 | usAfsagaAfgUfAfacauAfcAfuccuasasa | 1895 | antis | 23 |

-continued

| Unmodified sequence | SEQ ID NO: | Modified sequence | SEQ ID NO: | strand | Length |
|---|---|---|---|---|---|
| UUAGGAUGUAUGUUACUUCUU | 800 | ususaggaUfgUfAfUfguuacuucuuL96 | 1896 | sense | 21 |
| AAGAAGUAACAUACAUCCUAAAA | 801 | asAfsgaaGfuAfAfcauaCfaUfccuaasasa | 1897 | antis | 23 |
| AGAAAGGUGUUCAAGAUGUCC | 802 | asgsaaagGfuGfUfUfcaagauguccL96 | 1898 | sense | 21 |
| GGACAUCUUGAACACCUUUCUCC | 803 | gsGfsacaUfcUfUfgaacAfcCfuuucuscsc | 1899 | antis | 23 |
| GAAAGGUGUUCAAGAUGUCCU | 804 | gsasaaggUfgUfUfCfaagauguccuL96 | 1900 | sense | 21 |
| AGGACAUCUUGAACACCUUUCUC | 805 | asGfsgacAfuCfUfugaaCfaCfcuuucsusc | 1901 | antis | 23 |
| GGGGAGAAAGGUGUUCAAGAU | 806 | gsgsggagAfaAfGfGfuguucaagauL96 | 1902 | sense | 21 |
| AUCUUGAACACCUUUCUCCCCCU | 807 | asUfscuuGfaAfCfaccuUfuCfucccscsu | 1903 | antis | 23 |
| GGGGGAGAAAGGUGUUCAAGA | 808 | gsgsggaGfaAfAfGfguguucaagaL96 | 1904 | sense | 21 |
| UCUUGAACACCUUUCUCCCCCUG | 809 | usCfsuugAfaCfCfccuuUfcUfcccccsusg | 1905 | antis | 23 |
| AGAAACUUUGGCUGAUAAUAU | 810 | asgsaaacUfuUfGfGfcugauaauauL96 | 1906 | sense | 21 |
| AUAUUAUCAGCCAAAGUUUCUUC | 811 | asUfsauuAfuCfAfgccaAfaGfuuucususc | 1907 | antis | 23 |
| GAAACUUUGGCUGAUAAUAUU | 812 | gsasaacuUfuGfGfCfugauaauauuL96 | 1908 | sense | 21 |
| AAUAUUAUCAGCCAAAGUUUCUU | 813 | asAfsuauUfaUfCfagccAfaAfguuucsusu | 1909 | antis | 23 |
| AUGAAGAAACUUUGGCUGAUA | 814 | asusgaagAfaAfCfUfuuggcugauaL96 | 1910 | sense | 21 |
| UAUCAGCCAAAGUUUCUUCAUCA | 815 | usAfsucaGfcCfAfaaguUfuCfuucauscsa | 1911 | antis | 23 |
| GAUGAAGAAACUUUGGCUGAU | 816 | gsasugaaGfaAfAfCfuuuggcugauL96 | 1912 | sense | 21 |
| AUCAGCCAAAGUUUCUUCAUCAU | 817 | asUfscagCfcAfAfaguuUfcUfucaucsasu | 1913 | antis | 23 |
| AAGGCACUGAUGUUCUGAAAG | 818 | asasggcaCfuGfAfUfguucugaaagL96 | 1914 | sense | 21 |
| CUUUCAGAACAUCAGUGCCUUUC | 819 | csUfsuucAfgAfAfcaucAfgUfgccuususc | 1915 | antis | 23 |
| AGGCACUGAUGUUCUGAAAGC | 820 | asgsgcacUfgAfUfGfuucugaaagcL96 | 1916 | sense | 21 |
| GCUUUCAGAACAUCAGUGCCUUU | 821 | gsCfsuuuCfaGfAfacauCfaGfugccususu | 1917 | antis | 23 |
| CGGAAAGGCACUGAUGUUCUG | 822 | csgsgaaaGfcGfAfCfugauguucugL96 | 1918 | sense | 21 |
| CAGAACAUCAGUGCCUUUCCGCA | 823 | csAfsgaaCfaUfCfagugCfcUfuuccgscsa | 1919 | antis | 23 |
| GCGGAAAGGCACUGAUGUUCU | 824 | gscsggaaAfgGfCfAfcugauguucuL96 | 1920 | sense | 21 |
| AGAACAUCAGUGCCUUUCCGCAC | 825 | asGfsaacAfuCfAfgugcCfuUfuccgcsasc | 1921 | antis | 23 |
| AGAAGACUGACAUCAUUGCCA | 826 | asgsaagaCfuGfAfCfaucauugccaL96 | 1922 | sense | 21 |
| UGGCAAUGAUGUCAGUCUUCUCA | 827 | usGfsgcaAfuGfAfugucAfgUfcuucuscsa | 1923 | antis | 23 |
| GAAGACUGACAUCAUUGCCAA | 828 | gsasagacUfgAfCfAfucauugccaaL96 | 1924 | sense | 21 |
| UUGGCAAUGAUGUCAGUCUUCUC | 829 | usUfsggcAfaUfGfauguCfaGfucuucsusc | 1925 | antis | 23 |
| GCUGAGAAGACUGACAUCAUU | 830 | gscsugagAfaGfAfCfugacaucauuL96 | 1926 | sense | 21 |
| AAUGAUGUCAGUCUUCUCAGCCA | 831 | asAfsugaUfgUfCfagucUfuCfucagcscsa | 1927 | antis | 23 |
| GGCUGAGAAGACUGACAUCAU | 832 | gsgscugaGfaAfGfAfcugacaucauL96 | 1928 | sense | 21 |
| AUGAUGUCAGUCUUCUCAGCCAU | 833 | asUfsgauGfuCfAfgucuUfcUfcagccsasu | 1929 | antis | 23 |
| UAAUGCCUGAUUCACAACUUU | 834 | usasaugcCfuGfAfUfucacaacuuuL96 | 1930 | sense | 21 |
| AAAGUUGUGAAUCAGGCAUUACC | 835 | asAfsaguUfgUfGfaaucAfgGfcauuascsc | 1931 | antis | 23 |
| AAUGCCUGAUUCACAACUUUG | 836 | asasugccUfgAfUfUfcacaacuuugL96 | 1932 | sense | 21 |
| CAAAGUUGUGAAUCAGGCAUUAC | 837 | csAfsaagUfuGfUfgaauCfaGfgcauusasc | 1933 | antis | 23 |

-continued

| Unmodified sequence | SEQ ID NO: | Modified sequence | SEQ ID NO: | strand | Length |
|---|---|---|---|---|---|
| UUGGUAAUGCCUGAUUCACAA | 838 | ususgguaAfuGfCfCfugauucacaaL96 | 1934 | sense | 21 |
| UUGUGAAUCAGGCAUUACCAACA | 839 | usUfsgugAfaUfCfaggcAfuUfaccaascsa | 1935 | antis | 23 |
| GUUGGUAAUGCCUGAUUCACA | 840 | gsusugguAfaUfGfCfcugauucacaL96 | 1936 | sense | 21 |
| UGUGAAUCAGGCAUUACCAACAC | 841 | usGfsugaAfuCfAfggcaUfuAfccaacsasc | 1937 | antis | 23 |
| UAUCAAAUGGCUGAGAAGACU | 842 | usasucaaAfuGfGfCfugagaagacuL96 | 1938 | sense | 21 |
| AGUCUUCUCAGCCAUUUGAUAUC | 843 | asGfsucuUfcUfCfagccAfuUfugauasusc | 1939 | antis | 23 |
| AUCAAAUGGCUGAGAAGACUG | 844 | asuscaaaUfgGfCfUfgagaagacugL96 | 1940 | sense | 21 |
| CAGUCUUCUCAGCCAUUUGAUAU | 845 | csAfsgucUfcUfCfcagcCfaUfuugausasu | 1941 | antis | 23 |
| AAGAUAUCAAAUGGCUGAGAA | 846 | asasgauaUfcAfAfAfuggcugagaaL96 | 1942 | sense | 21 |
| UUCUCAGCCAUUUGAUAUCUUCC | 847 | usUfscucAfgCfCfauuuGfaUfaucuuscsc | 1943 | antis | 23 |
| GAAGAUAUCAAAUGGCUGAGA | 848 | gsasagauAfuCfAfAfauggcugagaL96 | 1944 | sense | 21 |
| UCUCAGCCAUUUGAUAUCUUCCC | 849 | usCfsucaGfcCfAfuuugAfuAfucuuscscsc | 1945 | antis | 23 |
| UCUGACAGUGCACAAUAUUUU | 850 | uscsugacAfgUfGfCfacaauauuuuL96 | 1946 | sense | 21 |
| AAAAUAUUGUGCACUGUCAGAUC | 851 | asAfsaauAfuUfGfugcaCfuGfucagasusc | 1947 | antis | 23 |
| CUGACAGUGCACAAUAUUUUC | 852 | csusgacaGfuGfCfAfcaauauuuucL96 | 1948 | sense | 21 |
| GAAAAUAUUGUGCACUGUCAGAU | 853 | gsAfsaaaUfaUfUfgugcAfcUfgucagsasu | 1949 | antis | 23 |
| AAGAUCUGACAGUGCACAAUA | 854 | asasgaucUfgAfCfAfgugcacaauaL96 | 1950 | sense | 21 |
| UAUUGUGCACUGUCAGAUCUUGG | 855 | usAfsuugUfgCfAfcuguCfaGfaucuusgsg | 1951 | antis | 23 |
| CAAGAUCUGACAGUGCACAAU | 856 | csasagauCfuGfAfCfagugcacaauL96 | 1952 | sense | 21 |
| AUUGUGCACUGUCAGAUCUUGGA | 857 | asUfsuguGfcAfCfugucAfgAfucuugsgsa | 1953 | antis | 23 |
| ACUGAUGUUCUGAAAGCUCUG | 858 | ascsugauGfuUfCfUfgaaagcucugL96 | 1954 | sense | 21 |
| CAGAGCUUUCAGAACAUCAGUGC | 859 | csAfsgagCfuUfUfcagaAfcAfucagusgsc | 1955 | antis | 23 |
| CUGAUGUUCUGAAAGCUCUGG | 860 | csusgaugUfuCfUfGfaaagcucuggL96 | 1956 | sense | 21 |
| CCAGAGCUUUCAGAACAUCAGUG | 861 | csCfsagaGfcUfUfucagAfaCfaucagsusg | 1957 | antis | 23 |
| AGGCACUGAUGUUCUGAAAGC | 862 | asgsgcacUfgAfUfGfuucugaaagcL96 | 1958 | sense | 21 |
| GCUUUCAGAACAUCAGUGCCUUU | 863 | gsCfsuuuCfaGfAfacauCfaGfugccususu | 1959 | antis | 23 |
| AAGGCACUGAUGUUCUGAAAG | 864 | asasggcaCfuGfAfUfguucugaaagL96 | 1960 | sense | 21 |
| CUUUCAGAACAUCAGUGCCUUUC | 865 | csUfsuucAfgAfAfcaucAfgUfgccuususc | 1961 | antis | 23 |
| AACAACAUGCUAAAUCAGUAC | 866 | asascaacAfuGfCfUfaaaucaguacL96 | 1962 | sense | 21 |
| GUACUGAUUUAGCAUGUUGUUCA | 867 | gsUfsacuGfaUfUfuagcAfuGfuuguuscsa | 1963 | antis | 23 |
| ACAACAUGCUAAAUCAGUACU | 868 | ascsaacaUfgCfUfAfaaucaguacuL96 | 1964 | sense | 21 |
| AGUACUGAUUUAGCAUGUUGUUC | 869 | asGfsuacUfgAfUfuuagCfaUfguugususc | 1965 | antis | 23 |
| UAUGAACAACAUGCUAAAUCA | 870 | usasugaaCfaAfCfAfugcuaaaucaL96 | 1966 | sense | 21 |
| UGAUUUAGCAUGUUGUUCAUAAU | 871 | usGfsauuUfaGfCfauguUfgUfucauasasu | 1967 | antis | 23 |
| UUAUGAACAACAUGCUAAAUC | 872 | ususaugaAfcAfAfCfaugcuaaaucL96 | 1968 | sense | 21 |
| GAUUUAGCAUGUUGUUCAUAAUC | 873 | gsAfsuuuAfgCfAfuguuGfuUfcauaasusc | 1969 | antis | 23 |
| UCUUUAGUGUCUGAAUAUAUC | 874 | uscsuuuaGfuGfUfCfugaauauaucL96 | 1970 | sense | 21 |
| GAUAUAUUCAGACACUAAAGAUG | 875 | gsAfsuauAfuUfCfagacAfcUfaaagasusg | 1971 | antis | 23 |

-continued

| Unmodified sequence | SEQ ID NO: | Modified sequence | SEQ ID NO: | strand | Length |
|---|---|---|---|---|---|
| CUUUAGUGUCUGAAUAUAUCC | 876 | csusuuagUfgUfCfUfgaauauauccL96 | 1972 | sense | 21 |
| GGAUAUAUUCAGACACUAAAGAU | 877 | gsGfsauaUfaUfUfcagaCfaCfuaaagsasu | 1973 | antis | 23 |
| CACAUCUUUAGUGUCUGAAUA | 878 | csascaucUfuUfAfGfugucugaauaL96 | 1974 | sense | 21 |
| UAUUCAGACACUAAAGAUGUGAU | 879 | usAfsuucAfgAfCfacuaAfaGfaugugsasu | 1975 | antis | 23 |
| UCACAUCUUUAGUGUCUGAAU | 880 | uscsacauCfuUfUfAfgugucugaauL96 | 1976 | sense | 21 |
| AUUCAGACACUAAAGAUGUGAUU | 881 | asUfsucaGfaCfAfcuaaAfgAfugugasusu | 1977 | antis | 23 |
| UGAUACUUCUUUGAAUGUAGA | 882 | usgsauacUfuCfUfUfugaauguagaL96 | 1978 | sense | 21 |
| UCUACAUUCAAAGAAGUAUCACC | 883 | usCfsuacAfuUfCfaaagAfaGfuaucascsc | 1979 | antis | 23 |
| GAUACUUCUUUGAAUGUAGAU | 884 | gsasuacuUfcUfUfUfgaauguagauL96 | 1980 | sense | 21 |
| AUCUACAUUCAAAGAAGUAUCAC | 885 | asUfscuaCfaUfUfcaaaGfaAfguaucsasc | 1981 | antis | 23 |
| UUGGUGAUACUUCUUUGAAUG | 886 | ususggugAfuAfCfUfucuuugaaugL96 | 1982 | sense | 21 |
| CAUUCAAAGAAGUAUCACCAAUU | 887 | csAfsuucAfaAfGfaaguAfuCfaccaasusu | 1983 | antis | 23 |
| AUUGGUGAUACUUCUUUGAAU | 888 | asusugguGfaUfAfCfuucuuugaauL96 | 1984 | sense | 21 |
| AUUCAAAGAAGUAUCACCAAUUA | 889 | asUfsucaAfaGfAfaguaUfcAfccaaususa | 1985 | antis | 23 |
| AAUAACCUGUGAAAAUGCUCC | 890 | asasuaacCfuGfUfGfaaaaugcuccL96 | 1986 | sense | 21 |
| GGAGCAUUUUCACAGGUUAUUGC | 891 | gsGfsagcAfuUfUfucacAfgGfuuauusgsc | 1987 | antis | 23 |
| AUAACCUGUGAAAAUGCUCCC | 892 | asusaaccUfgUfGfAfaaaaugcucccL96 | 1988 | sense | 21 |
| GGGAGCAUUUUCACAGGUUAUUG | 893 | gsGfsgagCfaUfUfuucaCfaGfguuaususg | 1989 | antis | 23 |
| UAGCAAUAACCUGUGAAAAUG | 894 | usasgcaaUfaAfCfCfugugaaaaugL96 | 1990 | sense | 21 |
| CAUUUUCACAGGUUAUUGCUAUC | 895 | csAfsuuuUfcAfCfagguUfaUfugcuasusc | 1991 | antis | 23 |
| AUAGCAAUAACCUGUGAAAAU | 896 | asusagcaAfuAfAfCfcugugaaaauL96 | 1992 | sense | 21 |
| AUUUUCACAGGUUAUUGCUAUCC | 897 | asUfsuuuCfaCfAfgguuAfuUfgcuauscsc | 1993 | antis | 23 |
| AAUCACAUCUUUAGUGUCUGA | 898 | asasucacAfuCfUfUfuagugucugaL96 | 1994 | sense | 21 |
| UCAGACACUAAAGAUGUGAUUGG | 899 | usCfsagaCfaCfUfaaagAfuGfugauusgsg | 1995 | antis | 23 |
| AUCACAUCUUUAGUGUCUGAA | 900 | asuscacaUfcUfUfUfagugucugaaL96 | 1996 | sense | 21 |
| UUCAGACACUAAAGAUGUGAUUG | 901 | usUfscagAfcAfCfuaaaGfaUfgugaususg | 1997 | antis | 23 |
| UUCCAAUCACAUCUUUAGUGU | 902 | ususccaaUfcAfCfAfucuuuaguguL96 | 1998 | sense | 21 |
| ACACUAAAGAUGUGAUUGGAAAU | 903 | asCfsacuAfaAfGfauguGfaUfuggaasasu | 1999 | antis | 23 |
| UUUCCAAUCACAUCUUUAGUG | 904 | ususuccaAfuCfAfCfaucuuuagugL96 | 2000 | sense | 21 |
| CACUAAAGAUGUGAUUGGAAAUC | 905 | csAfscuaAfaGfAfugugAfuUfggaaasusc | 2001 | antis | 23 |
| ACGGGCAUGAUGUUGAGUUCC | 906 | ascsgggcAfuGfAfUfguugaguuccL96 | 2002 | sense | 21 |
| GGAACUCAACAUCAUGCCCGUUC | 907 | gsGfsaacUfcAfAfcaucAfuGfcccgsusus | 2003 | antis | 23 |
| CGGGCAUGAUGUUGAGUUCCU | 908 | csgsggcaUfgAfUfGfuugaguuccuL96 | 2004 | sense | 21 |
| AGGAACUCAACAUCAUGCCCGUU | 909 | asGfsgaaCfuCfAfacauCfaUfgcccgsusu | 2005 | antis | 23 |
| GGGAACGGGCAUGAUGUUGAG | 910 | gsgsgaacGfgGfCfAfugaguugaagL96 | 2006 | sense | 21 |
| CUCAACAUCAUGCCCGUUCCCAG | 911 | csUfscaaCfaUfCfaugcCfcGfuucccsasg | 2007 | antis | 23 |
| UGGGAACGGGCAUGAUGUUGA | 912 | usgsggaaCfgGfGfCfaugauguugaL96 | 2008 | sense | 21 |
| UCAACAUCAUGCCCGUUCCCAGG | 913 | usCfsaacAfuCfAfugccCfgUfucccasgsg | 2009 | antis | 23 |

-continued

| Unmodified sequence | SEQ ID NO: | Modified sequence | SEQ ID NO: | strand | Length |
|---|---|---|---|---|---|
| ACUAAGGUGAAAAGAUAAUGA | 914 | ascsuaagGfuGfAfAfaagauaaaugaL96 | 2010 | sense | 21 |
| UCAUUAUCUUUUCACCUUAGUGU | 915 | usCfsauuAfuCfUfuuucAfcCfuuagugsu | 2011 | antis | 23 |
| CUAAGGUGAAAAGAUAAUGAU | 916 | csusaaggUfgAfAfAfagauaaugauL96 | 2012 | sense | 21 |
| AUCAUUAUCUUUUCACCUUAGUG | 917 | asUfscauUfaUfCfuuuuCfaCfcuuagsusg | 2013 | antis | 23 |
| AAACACUAAGGUGAAAAGAUA | 918 | asasacacUfaAfGfGfugaaaagauaL96 | 2014 | sense | 21 |
| UAUCUUUUCACCUUAGUGUUUGC | 919 | usAfsucuUfuUfCfaccuUfaGfuguuusgsc | 2015 | antis | 23 |
| CAAACACUAAGGUGAAAAGAU | 920 | csasaacaCfuAfAfGfgugaaaagauL96 | 2016 | sense | 21 |
| AUCUUUUCACCUUAGUGUUUGCU | 921 | asUfscuuUfuCfAfccuuAfgUfguuugscsu | 2017 | antis | 23 |
| AGGUAGCACUGGAGAGAAUUG | 922 | asgsguagCfaCfUfGfgagagaauugL96 | 2018 | sense | 21 |
| CAAUUCUCUCCAGUGCUACCUUC | 923 | csAfsauuCfuCfUfccagUfgCfuaccususc | 2019 | antis | 23 |
| GGUAGCACUGGAGAGAAUUGG | 924 | gsgsuagcAfcUfGfGfagagaauuggL96 | 2020 | sense | 21 |
| CCAAUUCUCUCCAGUGCUACCUU | 925 | csCfsaauUfcUfCfuccaGfuGfcuaccsusu | 2021 | antis | 23 |
| GAGAAGGUAGCACUGGAGAGA | 926 | gsasgaagGfuAfGfCfacuggagagaL96 | 2022 | sense | 21 |
| UCUCUCCAGUGCUACCUUCUCAA | 927 | usCfsucuCfcAfGfugcuAfcCfuucucsasa | 2023 | antis | 23 |
| UGAGAAGGUAGCACUGGAGAG | 928 | usgsagaaGfgUfAfGfcacuggagagL96 | 2024 | sense | 21 |
| CUCUCCAGUGCUACCUUCUCAAA | 929 | csUfscucCfaGfUfgcuaCfcUfucucasasa | 2025 | antis | 23 |
| AGUGGACUUGCUGCAUAUGUG | 930 | asgsuggaCfuUfGfCfugcauaugugL96 | 2026 | sense | 21 |
| CACAUAUGCAGCAAGUCCACUGU | 931 | csAfscauAfuGfCfagcaAfgUfccacusgsu | 2027 | antis | 23 |
| GUGGACUUGCUGCAUAUGUGG | 932 | gsusggacUfuGfCfUfgcauaugugGL96 | 2028 | sense | 21 |
| CCACAUAUGCAGCAAGUCCACUG | 933 | csCfsacaUfaUfGfcagcAfaGfuccacsusg | 2029 | antis | 23 |
| CGACAGUGGACUUGCUGCAUA | 934 | csgsacagUfgGfAfCfuugcugcauaL96 | 2030 | sense | 21 |
| UAUGCAGCAAGUCCACUGUCGUC | 935 | usAfsugcAfgCfAfagucCfaCfugucgsusc | 2031 | antis | 23 |
| ACGACAGUGGACUUGCUGCAU | 936 | ascsgacaGfuGfGfAfcuugcugcauL96 | 2032 | sense | 21 |
| AUGCAGCAAGUCCACUGUCGUCU | 937 | asUfsgcaGfcAfAfguccAfcUfgucguscsu | 2033 | antis | 23 |
| AAGGUGUUCAAGAUGUCCUCG | 938 | asasggugUfcUfAfAfgauguccucgL96 | 2034 | sense | 21 |
| CGAGGACAUCUUGAACACCUUUC | 939 | csGfsaggAfcAfUfcuugAfaCfaccuususc | 2035 | antis | 23 |
| AGGUGUUCAAGAUGUCCUCGA | 940 | asgsguguUfcAfAfGfauguccucgaL96 | 2036 | sense | 21 |
| UCGAGGACAUCUUGAACACCUUU | 941 | usCfsgagGfaCfAfucuuGfaAfcaccususu | 2037 | antis | 23 |
| GAGAAAGGUGUUCAAGAUGUC | 942 | gsasgaaaGfgUfGfUfucaagaugucL96 | 2038 | sense | 21 |
| GACAUCUUGAACACCUUUCUCCC | 943 | gsAfscauCfuUfGfaacaCfcUfuucucscsc | 2039 | antis | 23 |
| GGAGAAAGGUGUUCAAGAUGU | 944 | gsgsagaaAfgGfUfGfuucaagauguL96 | 2040 | sense | 21 |
| ACAUCUUGAACACCUUUCUCCCC | 945 | asCfsaucUfuGfAfacacCfuUfucuccscsc | 2041 | antis | 23 |
| AACCGUCUGGAUGAUGUGCGU | 946 | asasccguCfuGfGfAfugaugugcguL96 | 2042 | sense | 21 |
| ACGCACAUCAUCCAGACGGUUGC | 947 | asCfsgcaCfaUfCfauccAfgAfcgguusgsc | 2043 | antis | 23 |
| ACCGUCUGGAUGAUGUGCGUA | 948 | ascscgucUfgGfAfUfgaugugcguaL96 | 2044 | sense | 21 |
| UACGCACAUCAUCCAGACGGUUG | 949 | usAfscgcAfcAfUfcaucCfaGfacggususg | 2045 | antis | 23 |
| GGGCAACCGUCUGGAUGAUGU | 950 | gsgsgcaaCfcGfUfCfuggaugauguL96 | 2046 | sense | 21 |
| ACAUCAUCCAGACGGUUGCCCAG | 951 | asCfsaucAfuCfCfagacGfgUfugcccsasg | 2047 | antis | 23 |

-continued

| Unmodified sequence | SEQ ID NO: | Modified sequence | SEQ ID NO: | strand | Length |
|---|---|---|---|---|---|
| UGGGCAACCGUCUGGAUGAUG | 952 | usgsggcaAfcCfGfUfcuggaugaugL96 | 2048 | sense | 21 |
| CAUCAUCCAGACGGUUGCCCAGG | 953 | csAfsucaUfcCfAfgacgGfuUfgcccasgsg | 2049 | antis | 23 |
| GAAACUUUGGCUGAUAAUAUU | 954 | gsasaacuUfuGfGfCfugauaauauuL96 | 2050 | sense | 21 |
| AAUAUUAUCAGCCAAAGUUUCUU | 955 | asAfsuauUfaUfCfagccAfaAfguuucsusu | 2051 | antis | 23 |
| AAACUUUGGCUGAUAAUAUUG | 956 | asasacuuUfgGfCfUfgauaauauugL96 | 2052 | sense | 21 |
| CAAUAUUAUCAGCCAAAGUUUCU | 957 | csAfsauaUfuAfUfcagcCfaAfaguuucsu | 2053 | antis | 23 |
| UGAAGAAACUUUGGCUGAUAA | 958 | usgsaagaAfaCfUfUfuggcugauaaL96 | 2054 | sense | 21 |
| UUAUCAGCCAAAGUUUCUUCAUC | 959 | usUfsaucAfgCfCfaaagUfuUfcuucasusc | 2055 | antis | 23 |
| AUGAAGAAACUUUGGCUGAUA | 960 | asusgaagAfaAfCfUfuuggcugauaL96 | 2056 | sense | 21 |
| UAUCAGCCAAAGUUUCUUCAUCA | 961 | usAfsucaGfcCfAfaaguUfuCfuucauscsa | 2057 | antis | 23 |
| AAAGGUGUUCAAGAUGUCCUC | 962 | asasagguGfuUfCfAfagaugnccucL96 | 2058 | sense | 21 |
| GAGGACAUCUUGAACACCUUUCU | 963 | gsAfsggaCfaUfCfuugaAfcAfccuuuscsu | 2059 | antis | 23 |
| AAGGUGUUCAAGAUGUCCUCG | 964 | asasggugUfuCfAfAfgaugnccucgL96 | 2060 | sense | 21 |
| CGAGGACAUCUUGAACACCUUUC | 965 | csGfsaggAfcAfUfcuugAfaCfaccuuusnsc | 2061 | antis | 23 |
| GGAGAAAGGUGUUCAAGAUGU | 966 | gsgsagaaAfgGfUfGfuucaagauguL96 | 2062 | sense | 21 |
| ACAUCUUGAACACCUUUCUCCCC | 967 | asCfsaucUfuGfAfacacCfuUfucucscscsc | 2063 | antis | 23 |
| GGGAGAAAGGUGUUCAAGAUG | 968 | gsgsgagaAfaGfGfUfguucaagaugL96 | 2064 | sense | 21 |
| CAUCUUGAACACCUUUCUCCCCC | 969 | csAfsucuUfgAfAfcaccUfuUfcucccscsc | 2065 | antis | 23 |
| AAAUCAGUACUUCCAAAGUCU | 970 | asasaucaGfuAfCfUfuccaaagucuL96 | 2066 | sense | 21 |
| AGACUUUGGAAGUACUGAUUUAG | 971 | asGfsacuUfuGfGfaaguAfcUfgauuusasg | 2067 | antis | 23 |
| AAUCAGUACUUCCAAAGUCUA | 972 | asasucagUfaCfUfUfccaaagucuaL96 | 2068 | sense | 21 |
| UAGACUUUGGAAGUACUGAUUUA | 973 | usAfsgacUfuUfGfgaagUfaCfugauususa | 2069 | antis | 23 |
| UGCUAAAUCAGUACUUCCAAA | 974 | usgscuaaAfuCfAfGfuacuuccaaaL96 | 2070 | sense | 21 |
| UUUGGAAGUACUGAUUUAGCAUG | 975 | usUfsuggAfaGfUfacugAfuUfuagcasusg | 2071 | antis | 23 |
| AUGCUAAAUCAGUACUUCCAA | 976 | asusgcuaAfaUfCfAfguacuuccaaL96 | 2072 | sense | 21 |
| UUGGAAGUACUGAUUUAGCAUGU | 977 | usUfsggaAfgUfAfcugaUfuUfagcausgsu | 2073 | antis | 23 |
| ACAUCUUUAGUGUCUGAAUAU | 978 | ascsaucuUfuAfGfUfgucugaauauL96 | 2074 | sense | 21 |
| AUAUUCAGACACUAAAGAUGUGA | 979 | asUfsauuCfaGfAfcacuAfaAfgaugusgsa | 2075 | antis | 23 |
| CAUCUUUAGUGUCUGAAUAUA | 980 | csasucuuUfaGfUfGfucugaauauaL96 | 2076 | sense | 21 |
| UAUAUUCAGACACUAAAGAUGUG | 981 | usAfsuauUfcAfGfacacUfaAfagaugsusg | 2077 | antis | 23 |
| AAUCACAUCUUUAGUGUCUGA | 982 | asasucacAfuCfUfUfuagugucugaL96 | 2078 | sense | 21 |
| UCAGACACUAAAGAUGUGAUUGG | 983 | usCfsagaCfaCfUfaaagAfuGfugauusgsg | 2079 | antis | 23 |
| CAAUCACAUCUUUAGUGUCUG | 984 | csasaucaCfaUfCfUfuuagugucugL96 | 2080 | sense | 21 |
| CAGACACUAAAGAUGUGAUUGGA | 985 | csAfsgacAfcUfAfaagaUfgUfgauugsgsa | 2081 | antis | 23 |
| GCAUGUAUUACUUGACAAAGA | 986 | gscsauguAfuUfAfCfuugacaaagaL96 | 2082 | sense | 21 |
| UCUUUGUCAAGUAAUACAUGCUG | 987 | usCfsuuuGfuCfAfaguaAfuAfcaugcsusg | 2083 | antis | 23 |
| CAUGUAUUACUUGACAAAGAG | 988 | csasuguaUfuAfCfUfugacaaagagL96 | 2084 | sense | 21 |
| CUCUUUGUCAAGUAAUACAUGCU | 989 | csUfscuuUfgUfCfaaguAfaUfacaugscsu | 2085 | antis | 23 |

| Unmodified sequence | SEQ ID NO: | Modified sequence | SEQ ID NO: | strand | Length |
|---|---|---|---|---|---|
| UUCAGCAUGUAUUACUUGACA | 990 | ususcagcAfuGfUfAfuuacuugacaL96 | 2086 | sense | 21 |
| UGUCAAGUAAUACAUGCUGAAAA | 991 | usGfsucaAfgUfAfauacAfuGfcugaasasa | 2087 | antis | 23 |
| UUUCAGCAUGUAUUACUUGAC | 992 | ususucagCfaUfGfUfauuacuugacL96 | 2088 | sense | 21 |
| GUCAAGUAAUACAUGCUGAAAA | 993 | gsUfscaaGfuAfAfuacaUfgCfugaaasasa | 2089 | antis | 23 |
| AUGUUACUUCUUAGAGAGAAA | 994 | asusguuaCfuUfCfCfUfuagagagaaaL96 | 2090 | sense | 21 |
| UUUCUCUCUAAGAAGUAACAUAC | 995 | usUfsucuCfuCfUfaagaAfgUfaacausasc | 2091 | antis | 23 |
| UGUUACUUCUUAGAGAGAAAU | 996 | usgsuuacUfuCfUfUfagagagaaauL96 | 2092 | sense | 21 |
| AUUUCUCUCUAAGAAGUAACAUA | 997 | asUfsuucUfcUfCfuaagAfaGfuaacasusa | 2093 | antis | 23 |
| AUGUAUGUUACUUCUUAGAGA | 998 | asusguauGfuUfAfCfuucuuagagaL96 | 2094 | sense | 21 |
| UCUCUAAGAAGUAACAUACAUCC | 999 | usCfsucuAfaGfAfaguaAfcAfuacauscsc | 2095 | antis | 23 |
| GAUGUAUGUUACUUCUUAGAG | 1000 | gsasuguaUfgUfUfAfcuucuuagagL96 | 2096 | sense | 21 |
| CUCUAAGAAGUAACAUACAUCCU | 1001 | csUfscuaAfgAfAfguaaCfaUfacaucscsu | 2097 | antis | 23 |
| ACAACUUUGAGAAGGUAGCAC | 1002 | ascsaacuUfgAfGfAfaagguagcacL96 | 2098 | sense | 21 |
| GUGCUACCUUCUCAAAGUUGUGA | 1003 | gsUfsgcuAfcCfUfucuCfaAfaguugusgsa | 2099 | antis | 23 |
| CAACUUUGAGAAGGUAGCACU | 1004 | csasacuuUfgAfGfAfaggguagcacuL96 | 2100 | sense | 21 |
| AGUGCUACCUUCUCAAAGUUGUG | 1005 | asGfsugcUfaCfCfuucuCfaAfaguugsusg | 2101 | antis | 23 |
| AUUCACAACUUUGAGAAGGUA | 1006 | asusucacAfaCfUfUfugagaagguaL96 | 2102 | sense | 21 |
| UACCUUCUCAAAGUUGUGAAUCA | 1007 | usAfsccuUfcUfCfaaagUfuGfugaauscsa | 2103 | antis | 23 |
| GAUUCACAACUUUGAGAAGGU | 1008 | gsasuucaCfaAfCfUfuugagaagguL96 | 2104 | sense | 21 |
| ACCUUCUCAAAGUUGUGAAUCAG | 1009 | asCfscuuCfuCfAfaaguUfgUfgaaucsasg | 2105 | antis | 23 |
| AACAUGCUAAAUCAGUACUUC | 1010 | asascaugCfuAfAfAfucaguacuucL96 | 2106 | sense | 21 |
| GAAGUACUGAUUUAGCAUGUUGU | 1011 | gsAfsaguAfcUfGfauuuAfgCfauguusgsu | 2107 | antis | 23 |
| ACAUGCUAAAUCAGUACUUCC | 1012 | ascsaugcUfaAfAfUfcaguacuuccL96 | 2108 | sense | 21 |
| GGAAGUACUGAUUUAGCAUGUUG | 1013 | gsGfsaagUfaCfUfgauuUfaGfcaugususg | 2109 | antis | 23 |
| GAACAACAUGCUAAAUCAGUA | 1014 | gsasacaaCfaUfGfCfuaaaucaguaL96 | 2110 | sense | 21 |
| UACUGAUUUAGCAUGUUGUUCAU | 1015 | usAfscugAfuUfUfagcaUfgUfuguucsasu | 2111 | antis | 23 |
| UGAACAACAUGCUAAAUCAGU | 1016 | usgsaacaAfcAfUfGfcuaaaucaguL96 | 2112 | sense | 21 |
| ACUGAUUUAGCAUGUUGUUCAUA | 1017 | asCfsugaUfuUfAfgcauGfuUfguucasusa | 2113 | antis | 23 |
| AAACCAGUACUUUAUCAUUUU | 1018 | asasaccaGfuAfCfUfuuaucauuuuL96 | 2114 | sense | 21 |
| AAAAUGAUAAAGUACUGGUUUCA | 1019 | asAfsaauGfaUfAfaaguAfcUfgguuuscsa | 2115 | antis | 23 |
| AACCAGUACUUUAUCAUUUUC | 1020 | asasccagUfaCfUfUfuaucauuuucL96 | 2116 | sense | 21 |
| GAAAAUGAUAAAGUACUGGUUUC | 1021 | gsAfsaaaUfgAfUfaaagUfaCfugguususc | 2117 | antis | 23 |
| UUUGAAACCAGUACUUUAUCA | 1022 | ususugaaAfcCfAfGfuacuuuaucaL96 | 2118 | sense | 21 |
| UGAUAAAGUACUGGUUUCAAAAU | 1023 | usGfsauaAfaGfUfacugGfuUfucaaasasu | 2119 | antis | 23 |
| UUUUGAAACCAGUACUUUAUC | 1024 | ususugaAfaCfCfAfguacuuuaucL96 | 2120 | sense | 21 |
| GAUAAAGUACUGGUUUCAAAAUU | 1025 | gsAfsuaaAfgUfAfcuggUfuUfcaaaasusu | 2121 | antis | 23 |
| GAGAAGAUGGGCUACAAGGCC | 1026 | gsasgaagAfuGfGfGfcuacaaggccL96 | 2122 | sense | 21 |
| GGCCUUGUAGCCCAUCUUCUCUG | 1027 | gsGfsccuUfgUfAfgcccAfuCfuucucsusg | 2123 | antis | 23 |

| Unmodified sequence | SEQ ID NO: | Modified sequence | SEQ ID NO: | strand | Length |
|---|---|---|---|---|---|
| AGAAGAUGGGCUACAAGGCCA | 1028 | asgsaagaUfgGfGfCfuacaaggccaL96 | 2124 | sense | 21 |
| UGGCCUUGUAGCCCAUCUUCUCU | 1029 | usGfsgccUfuGfUfagccCfaUfcuucucsu | 2125 | antis | 23 |
| GGCAGAGAAGAUGGGCUACAA | 1030 | gsgscagaGfaAfGfAfugggcuacaaL96 | 2126 | sense | 21 |
| UUGUAGCCCAUCUUCUCUGCCUG | 1031 | usUfsguaGfcCfCfaucuUfcUfcugccusg | 2127 | antis | 23 |
| AGGCAGAGAAGAUGGGCUACA | 1032 | asgsgcagAfgAfAfGfaugggcuacaL96 | 2128 | sense | 21 |
| UGUAGCCCAUCUUCUCUGCCGC | 1033 | usGfsuagCfcCfAfucuuCfuCfugccusgc | 2129 | antis | 23 |
| AACGGGCAUGAUGUUGAGUUC | 1034 | asascgggCfaUfGfAfuguugaguucL96 | 2130 | sense | 21 |
| GAACUCAACAUCAUGCCCGUUCC | 1035 | gsAfsacuCfaAfCfaucaUfgCfccguuscsc | 2131 | antis | 23 |
| ACGGGCAUGAUGUUGAGUUCC | 1036 | ascsgggcAfuGfAfUfguugaguuccL96 | 2132 | sense | 21 |
| GGAACUCAACAUCAUGCCCGUUC | 1037 | gsGfsaacUfcAfAfcaucAfuGfcccgususc | 2133 | antis | 23 |
| UGGGAACGGGCAUGAUGUUGA | 1038 | usgsggaaCfgGfGfCfaugauguugaL96 | 2134 | sense | 21 |
| UCAACAUCAUGCCCGUUCCCAGG | 1039 | usCfsaacAfuCfAfugccCfgUfucccasgsg | 2135 | antis | 23 |
| CUGGGAACGGGCAUGAUGUUG | 1040 | csusgggaAfcGfGfGfcaugauguugL96 | 2136 | sense | 21 |
| CAACAUCAUGCCCGUUCCCAGGG | 1041 | csAfsacaUfcAfUfgcccGfuUfcccagsgsg | 2137 | antis | 23 |
| AUGUGGCUAAAGCAAUAGACC | 1042 | asusguggCfuAfAfAfgcaauagaccL96 | 2138 | sense | 21 |
| GGUCUAUUGCUUUAGCCACAUAU | 1043 | gsGfsucuAfuUfGfcuuuAfgCfcacausasu | 2139 | antis | 23 |
| UGUGGCUAAAGCAAUAGACCC | 1044 | usgsuggcUfaAfAfGfcaauagacccL96 | 2140 | sense | 21 |
| GGGUCUAUUGCUUUAGCCACAUA | 1045 | gsGfsgucUfaUfUfgcuuUfaGfccacasusa | 2141 | antis | 23 |
| GCAUAUGUGGCUAAAGCAAUA | 1046 | gscsauauGfuGfGfCfuaaagcaauaL96 | 2142 | sense | 21 |
| UAUUGCUUUAGCCACAUAUGCAG | 1047 | usAfsuugCfuUfUfagccAfcAfuaugcsasg | 2143 | antis | 23 |
| UGCAUAUGUGGCUAAAGCAAU | 1048 | usgscauaUfgUfGfGfcuaaagcaauL96 | 2144 | sense | 21 |
| AUUGCUUUAGCCACAUAUGCAGC | 1049 | asUfsugcUfuUfAfgccaCfaUfaugcasgsc | 2145 | antis | 23 |
| AGGAUGCUCCGGAAUGUUGCU | 1050 | asgsgaugCfuCfCfGfgaauguugcuL96 | 2146 | sense | 21 |
| AGCAACAUUCCGGAGCAUCCUUG | 1051 | asGfscaaCfaUfUfccggAfgCfauccususg | 2147 | antis | 23 |
| GGAUGCUCCGGAAUGUUGCUG | 1052 | gsgsaugcUfcCfGfGfaauguugcugL96 | 2148 | sense | 21 |
| CAGCAACAUUCCGGAGCAUCCUU | 1053 | csAfsgcaAfcAfUfuccgGfaGfcauccsusu | 2149 | antis | 23 |
| UCCAAGGAUGCUCCGGAAUGU | 1054 | uscscaagGfaUfGfCfuccggaauguL96 | 2150 | sense | 21 |
| ACAUUCCGGAGCAUCCUUGGAUA | 1055 | asCfsauuCfcGfGfagcaUfcCfuuggasusa | 2151 | antis | 23 |
| AUCCAAGGAUGCUCCGGAAUG | 1056 | asusccaaGfgAfUfGfcuccggaaugL96 | 2152 | sense | 21 |
| CAUUCCGGAGCAUCCUUGGAUAC | 1057 | csAfsuucCfgGfAfgcauCfcUfuggausasc | 2153 | antis | 23 |
| UCACAUCUUUAGUGUCUGAAU | 1058 | uscsacauCfuUfUfAfgugucugaauL96 | 2154 | sense | 21 |
| AUUCAGACACUAAAGAUGUGAUU | 1059 | asUfsucaGfaCfAfcuaaAfgAfugugasusu | 2155 | antis | 23 |
| CACAUCUUUAGUGUCUGAAUA | 1060 | csascaucUfuUfAfGfugucugaauaL96 | 2156 | sense | 21 |
| UAUUCAGACACUAAAGAUGUGAU | 1061 | usAfsuucAfgAfCfacuaAfaGfaugugsasu | 2157 | antis | 23 |
| CCAAUCACAUCUUUAGUGUCU | 1062 | cscsaaucAfcAfUfCfuuuagugucuL96 | 2158 | sense | 21 |
| AGACACUAAAGAUGUGAUUGGAA | 1063 | asGfsacaCfuAfAfagauGfuGfauuggsasa | 2159 | antis | 23 |
| UCCAAUCACAUCUUUAGUGUC | 1064 | uscscaauCfaCfAfUfcuuuagugucL96 | 2160 | sense | 21 |
| GACACUAAAGAUGUGAUUGGAAA | 1065 | gsAfscacUfaAfAfgaugUfgAfuuggasasa | 2161 | antis | 23 |

-continued

| Unmodified sequence | SEQ ID NO: | Modified sequence | SEQ ID NO: | strand | Length |
|---|---|---|---|---|---|
| AAAUGUGUUUAGACAACGUCA | 1066 | asasauguGfuUfUfAfgacaacgucaL96 | 2162 | sense | 21 |
| UGACGUUGUCUAAACACAUUUUC | 1067 | usGfsacgUfuGfUfcuaaAfcAfcauuususc | 2163 | antis | 23 |
| AAUGUGUUUAGACAACGUCAU | 1068 | asasugugUfuUfAfGfacaacgucauL96 | 2164 | sense | 21 |
| AUGACGUUGUCUAAACACAUUUU | 1069 | asUfsgacGfuUfGfucuaAfaCfacauususu | 2165 | antis | 23 |
| UUGAAAAUGUGUUUAGACAAC | 1070 | ususgaaaAfuGfUfGfuuuagacaacL96 | 2166 | sense | 21 |
| GUUGUCUAAACACAUUUUCAAUG | 1071 | gsUfsuguCfuAfAfacacAfuUfuucaasusg | 2167 | antis | 23 |
| AUUGAAAAUGUGUUUAGACAA | 1072 | asusugaaAfaUfGfUfguuuagacaaL96 | 2168 | sense | 21 |
| UUGUCUAAACACAUUUUCAAUGU | 1073 | usUfsgucUfaAfAfcacaUfuUfucaausgsu | 2169 | antis | 23 |
| UACUAAAGGAAGAAUUCCGGU | 1074 | usascuaaAfgGfAfAfgaauuccgguL96 | 2170 | sense | 21 |
| ACCGGAAUUCUUCCUUUAGUAUC | 1075 | asCfscggAfaUfUfcuucCfuUfuaguasusc | 2171 | antis | 23 |
| ACUAAAGGAAGAAUUCCGGUU | 1076 | ascsuaaaGfaAfAfGfaauuccgguuL96 | 2172 | sense | 21 |
| AACCGGAAUUCUUCCUUUAGUAU | 1077 | asAfsccgGfaAfUfucuuCfcUfuuagusasu | 2173 | antis | 23 |
| GAGAUACUAAAGGAAGAAUUC | 1078 | gsasgauaCfuAfAfAfggaagaauucL96 | 2174 | sense | 21 |
| GAAUUCUUCCUUUAGUAUCUCGA | 1079 | gsAfsauuCfuUfCfcuuuAfgUfaucucsgsa | 2175 | antis | 23 |
| CGAGAUACUAAAGGAAGAAUU | 1080 | csgsagauAfcUfAfAfaggaagaauuL96 | 2176 | sense | 21 |
| AAUUCUUCCUUUAGUAUCUCGAG | 1081 | asAfsuucUfuCfCfuuuaGfuAfucucgsasg | 2177 | antis | 23 |
| AACUUUGGCUGAUAAUAUUGC | 1082 | asascuuuGfgCfUfGfauaauauugcL96 | 2178 | sense | 21 |
| GCAAUAUUAUCAGCCAAAGUUUC | 1083 | gsCfsaauAfuUfAfucagCfcAfaaguususc | 2179 | antis | 23 |
| ACUUUGGCUGAUAAUAUUGCA | 1084 | ascsuuugGfcUfGfAfuaauauugcaL96 | 2180 | sense | 21 |
| UGCAAUAUUAUCAGCCAAAGUUU | 1085 | usGfscaaUfaUfUfaucaGfcCfaaagusususu | 2181 | antis | 23 |
| AAGAAACUUUGGCUGAUAAUA | 1086 | asasgaaaCfuUfUfGfgcugauaauaL96 | 2182 | sense | 21 |
| UAUUAUCAGCCAAAGUUUCUUCA | 1087 | usAfsuuaUfcAfGfccaaAfgUfuucuuscsa | 2183 | antis | 23 |
| GAAGAAACUUUGGCUGAUAAU | 1088 | gsasagaaAfcUfUfUfggcugauaauL96 | 2184 | sense | 21 |
| AUUAUCAGCCAAAGUUUCUUCAU | 1089 | asUfsuauCfaGfCfcaaaGfuUfucuucsasu | 2185 | antis | 23 |
| AAAUGGCUGAGAAGACUGACA | 1090 | asasauggCfuGfAfGfaagacugacaL96 | 2186 | sense | 21 |
| UGUCAGUCUUCUCAGCCAUUUGA | 1091 | usGfsucaGfuCfUfucucAfgCfcauuusgsa | 2187 | antis | 23 |
| AAUGGCUGAGAAGACUGACAU | 1092 | asasuggcUfgAfGfAfagacugacauL96 | 2188 | sense | 21 |
| AUGUCAGUCUUCUCAGCCAUUUG | 1093 | asUfsgucAfgUfCfuucuCfaGfccauususg | 2189 | antis | 23 |
| UAUCAAAUGGCUGAGAAGACU | 1094 | usasucaaAfuGfGfCfugagaagacuL96 | 2190 | sense | 21 |
| AGUCUUCUCAGCCAUUUGAUAUC | 1095 | asGfsucuUfcUfCfagccAfuUfugauasusc | 2191 | antis | 23 |
| AUAUCAAAUGGCUGAGAAGAC | 1096 | asusaucaAfaUfGfGfcugagaagacL96 | 2192 | sense | 21 |
| GUCUUCUCAGCCAUUUGAUAUCU | 1097 | gsUfscuuCfuCfAfgccaUfuUfgauauscsu | 2193 | antis | 23 |
| GUGGUUCUUAAAUUGUAAGCU | 1098 | gsusgguuCfuUfAfAfauuguaagcuL96 | 2194 | sense | 21 |
| AGCUUACAAUUUAAGAACCACUG | 1099 | asGfscuuAfcAfAfuuuaAfgAfaccacsusg | 2195 | antis | 23 |
| UGGUUCUUAAAUUGUAAGCUC | 1100 | usgsguucUfuAfAfAfuuguaagcucL96 | 2196 | sense | 21 |
| GAGCUUACAAUUUAAGAACCACU | 1101 | gsAfsgcuUfaCfAfauuuAfaGfaaccascsu | 2197 | antis | 23 |
| AACAGUGGUUCUUAAAUUGUA | 1102 | asascaguGfgUfUfCfuuaaauuguaL96 | 2198 | sense | 21 |
| UACAAUUUAAGAACCACUGUUUU | 1103 | usAfscaaUfuUfAfagaaCfcAfcuguusususu | 2199 | antis | 23 |

-continued

| Unmodified sequence | SEQ ID NO: | Modified sequence | SEQ ID NO: | strand | Length |
|---|---|---|---|---|---|
| AAACAGUGGUUCUUAAAUUGU | 1104 | asasacagUfgGfUfUfcuuaaauuguL96 | 2200 | sense | 21 |
| ACAAUUUAAGAACCACUGUUUUA | 1105 | asCfsaauUfuAfAfgaacCfaCfuguuususa | 2201 | antis | 23 |
| AAGUCAUCGACAAGACAUUGG | 1106 | asasgucaUfcGfAfCfaagacauuggL96 | 2202 | sense | 21 |
| CCAAUGUCUUGUCGAUGACUUUC | 1107 | csCfsaauGfuCfUfugucGfaUfgacuususc | 2203 | antis | 23 |
| AGUCAUCGACAAGACAUUGGU | 1108 | asgsucauCfgAfCfAfagacauugguL96 | 2204 | sense | 21 |
| ACCAAUGUCUUGUCGAUGACUUU | 1109 | asCfscaaUfgUfCfuuguCfgAfugacususu | 2205 | antis | 23 |
| GUGAAAGUCAUCGACAAGACA | 1110 | gsusgaaaGfuCfAfUfcgacaagacaL96 | 2206 | sense | 21 |
| UGUCUUGUCGAUGACUUUCACAU | 1111 | usGfsucuUfgUfCfgaugAfcUfuucacsasu | 2207 | antis | 23 |
| UGUGAAAGUCAUCGACAAGAC | 1112 | usgsugaaAfgUfCfAfucgacaagacL96 | 2208 | sense | 21 |
| GUCUUGUCGAUGACUUUCACAUU | 1113 | gsUfscuuGfuCfGfaugaCfuUfucacasusu | 2209 | antis | 23 |
| GAUAAUAUUGCAGCAUUUUCC | 1114 | gsasuaauAfuUfGfCfagcauuuuccL96 | 2210 | sense | 21 |
| GGAAAAUGCUGCAAUAUUAUCAG | 1115 | gsGfsaaaAfuGfCfugcaAfuAfuuaucsasg | 2211 | antis | 23 |
| AUAAUAUUGCAGCAUUUUCCA | 1116 | asusaauaUfuGfCfAfgcauuuuccaL96 | 2212 | sense | 21 |
| UGGAAAAUGCUGCAAUAUUAUCA | 1117 | usGfsgaaAfaUfGfcugcAfaUfauuauscsa | 2213 | antis | 23 |
| GGCUGAUAAUAUUGCAGCAUU | 1118 | gsgscugaUfaAfUfAfuugcagcauuL96 | 2214 | sense | 21 |
| AAUGCUGCAAUAUUAUCAGCCAA | 1119 | asAfsugcUfgCfAfauauUfaUfcagccsasa | 2215 | antis | 23 |
| UGGCUGAUAAUAUUGCAGCAU | 1120 | usgsgcugAfuAfAfUfauugcagcauL96 | 2216 | sense | 21 |
| AUGCUGCAAUAUUAUCAGCCAAA | 1121 | asUfsgcUfcAfAfuauuAfuCfagccasasa | 2217 | antis | 23 |
| GCUAAUUUGUAUCAAUGAUUA | 1122 | gscsuaauUfgUfGfUfAfucaaugauuaL96 | 2218 | sense | 21 |
| UAAUCAUUGAUACAAAUUAGCCG | 1123 | usAfsaucAfuUfGfauacAfaAfuuagcscsg | 2219 | antis | 23 |
| CUAAUUUGUAUCAAUGAUUAU | 1124 | csusaauuUfgUfAfUfcaaugauuauL96 | 2220 | sense | 21 |
| AUAAUCAUUGAUACAAAUUAGCC | 1125 | asUfsaauCfaUfUfgauaCfaAfauuagscsc | 2221 | antis | 23 |
| CCCGGCUAAUUUGUAUCAAUG | 1126 | cscscggcUfaAfUfUfuguaucaaugL96 | 2222 | sense | 21 |
| CAUUGAUACAAAUUAGCCGGGGG | 1127 | csAfsuugAfuAfCfaaauUfaGfccgggsgsg | 2223 | antis | 23 |
| CCCCGGCUAAUUUGUAUCAAU | 1128 | cscsccggCfuAfAfUfuuguaucaauL96 | 2224 | sense | 21 |
| AUUGAUACAAAUUAGCCGGGGA | 1129 | asUfsugaUfaCfAfaauuAfgCfcggggsgsa | 2225 | antis | 23 |
| UAAUGGUGAUACUUCUUUGA | 1130 | usasauugGfuGfAfUfacuucuuugaL96 | 2226 | sense | 21 |
| UCAAAGAAGUAUCACCAAUUACC | 1131 | usCfsaaaGfaAfGfuaucAfcCfaauuascsc | 2227 | antis | 23 |
| AAUUGGUGAUACUUCUUUGAA | 1132 | asasuuggUfgAfUfAfcuucuuugaaL96 | 2228 | sense | 21 |
| UUCAAAGAAGUAUCACCAAUUAC | 1133 | usUfscaaAfgAfAfguauCfaCfcaauusasc | 2229 | antis | 23 |
| GCGGUAAUUGGUGAUACUUCU | 1134 | gscsgguaAfuUfGfGfugauacuucuL96 | 2230 | sense | 21 |
| AGAAGUAUCACCAAUUACCGCCA | 1135 | asGfsaagUfaUfCfaccaAfuUfaccgcscsa | 2231 | antis | 23 |
| GGCGGUAAUUGGUGAUACUUC | 1136 | gsgscgguAfaUfUfGfgugauacuucL96 | 2232 | sense | 21 |
| GAAGUAUCACCAAUUACCGCCAC | 1137 | gsAfsaguAfuCfAfccaaUfuAfccgccsasc | 2233 | antis | 23 |
| CAGUGGUUCUUAAAUUGUAAG | 1138 | csasguggUfuCfUfUfaaauuguaagL96 | 2234 | sense | 21 |
| CUUACAAUUUAAGAACCACUGUU | 1139 | csUfsuacAfaUfUfuaagAfaCfcacugsusu | 2235 | antis | 23 |
| AGUGGUUCUUAAAUUGUAAGC | 1140 | asgsugguUfcUfUfAfaauuguaagcL96 | 2236 | sense | 21 |
| GCUUACAAUUUAAGAACCACUGU | 1141 | gsCfsuuaCfaAfUfuuaaGfaAfccacusgsu | 2237 | antis | 23 |

| Unmodified sequence | SEQ ID NO: | Modified sequence | SEQ ID NO: | strand | Length |
|---|---|---|---|---|---|
| AAAACAGUGGUUCUUAAAUUG | 1142 | asasaacaGfuGfGfUfucuuaaauugL96 | 2238 | sense | 21 |
| CAAUUUAAGAACCACUGUUUUAA | 1143 | csAfsauuUfaAfGfaaccAfcUfguuuusasa | 2239 | antis | 23 |
| UAAAACAGUGGUUCUUAAAUU | 1144 | usasaaacAfgUfGfGfuucuuaaauuL96 | 2240 | sense | 21 |
| AAUUUAAGAACCACUGUUUUAAA | 1145 | asAfsuuuAfaGfAfaccaCfuGfuuuuasasa | 2241 | antis | 23 |
| ACCUGUAUUCUGUUUACAUGU | 1146 | ascscuguAfuUfCfUfguuuacauguL96 | 2242 | sense | 21 |
| ACAUGUAAACAGAAUACAGGUUA | 1147 | asCfsaugUfaAfAfcagaAfuAfcaggususa | 2243 | antis | 23 |
| CCUGUAUUCUGUUUACAUGUC | 1148 | cscsuguaUfuCfUfGfuuuacaugucL96 | 2244 | sense | 21 |
| GACAUGUAAACAGAAUACAGGUU | 1149 | gsAfscauGfuAfAfacagAfaUfacaggsusu | 2245 | antis | 23 |
| AUUAACCUGUAUUCUGUUUAC | 1150 | asusuaacCfuGfUfAfuucuguuuacL96 | 2246 | sense | 21 |
| GUAAACAGAAUACAGGUUAAUAA | 1151 | gsUfsaaaCfaGfAfauacAfgGfuuaausasa | 2247 | antis | 23 |
| UAUUAACCUGUAUUCUGUUUA | 1152 | usasuuaaCfcUfGfUfauucuguuuaL96 | 2248 | sense | 21 |
| UAAACAGAAUACAGGUUAAUAAA | 1153 | usAfsaacAfgAfAfuacaGfgUfuaauasasa | 2249 | antis | 23 |
| AAGAAACUUUGGCUGAUAAUA | 1154 | asasgaaaCfuUfUfGfgcugauaauaL96 | 2250 | sense | 21 |
| UAUUAUCAGCCAAAGUUUCUUCA | 1155 | usAfsuuaUfcAfGfccaaAfgUfuucuuscsa | 2251 | antis | 23 |
| AGAAACUUUGGCUGAUAAUAU | 1156 | asgsaaacUfuUfGfGfcugauaauauL96 | 2252 | sense | 21 |
| AUAUUAUCAGCCAAAGUUUCUUC | 1157 | asUfsauuAfuCfAfgccaAfaGfuuucususc | 2253 | antis | 23 |
| GAUGAAGAAACUUUGGCUGAU | 1158 | gsasugaaGfaAfAfCfuuuggcugauL96 | 2254 | sense | 21 |
| AUCAGCCAAAGUUUCUUCAUCAU | 1159 | asUfscagCfcAfAfaguuUfcUfucaucsasu | 2255 | antis | 23 |
| UGAUGAAGAAACUUUGGCUGA | 1160 | usgsaugaAfgAfAfAfcuuuggcugaL96 | 2256 | sense | 21 |
| UCAGCCAAAGUUUCUUCAUCAUU | 1161 | usCfsagcCfaAfAfguuuCfuUfcaucasusu | 2257 | antis | 23 |
| GAAAGGUGUUCAAGAUGUCCU | 1162 | gsasaaggUfgUfUfCfaagauguccuL96 | 2258 | sense | 21 |
| AGGACAUCUUGAACACCUUUCUC | 1163 | asGfsgacAfuCfUfugaaCfaCfcuuucsusc | 2259 | antis | 23 |
| AAAGGUGUUCAAGAUGUCCUC | 1164 | asasagguGfuUfCfAfagauguccucL96 | 2260 | sense | 21 |
| GAGGACAUCUUGAACACCUUUCU | 1165 | gsAfsggaCfaUfCfuugaAfcAfccuuuscsu | 2261 | antis | 23 |
| GGGAGAAAGGUGUUCAAGAUG | 1166 | gsgsgagaAfaGfGfUfguucaagaugL96 | 2262 | sense | 21 |
| CAUCUUGAACACCUUUCUCCCCC | 1167 | csAfsucuUfgAfAfcaccUfuUfcucccscsc | 2263 | antis | 23 |
| GGGGAGAAAGGUGUUCAAGAU | 1168 | gsgsggagAfaAfGfGfuguucaagauL96 | 2264 | sense | 21 |
| AUCUUGAACACCUUUCUCCCCCU | 1169 | asUfscuuGfaAfCfaccuUfuCfucccscsu | 2265 | antis | 23 |
| AUCUUGGUGUCGAAUCAUGGG | 1170 | asuscuugGfuGfUfCfgaaucaugggL96 | 2266 | sense | 21 |
| CCCAUGAUUCGACACCAAGAUCC | 1171 | csCfscauGfaUfUfcgacAfcCfaagauscsc | 2267 | antis | 23 |
| UCUUGGUGUCGAAUCAUGGGG | 1172 | uscsuuggUfgUfCfGfaaucaugggggL96 | 2268 | sense | 21 |
| CCCCAUGAUUCGACACCAAGAUC | 1173 | csCfsccaUfgAfUfucgaCfaCfcaagasusc | 2269 | antis | 23 |
| UGGGAUCUUGGUGUCGAAUCA | 1174 | usgsggauCfuUfGfGfugucgaaucaL96 | 2270 | sense | 21 |
| UGAUUCGACACCAAGAUCCCAUU | 1175 | usGfsauuCfgAfCfaccaAfgAfucccasusu | 2271 | antis | 23 |
| AUGGGAUCUUGGUGUCGAAUC | 1176 | asusgggaUfcUfUfGfgugucgaaucL96 | 2272 | sense | 21 |
| GAUUCGACACCAAGAUCCCAUUC | 1177 | gsAfsuucGfaCfAfccaaGfaUfcccaususc | 2273 | antis | 23 |
| GCUACAAGGCCAUAUUUGUGA | 1178 | gscsuacaAfgGfCfCfauauuugugaL96 | 2274 | sense | 21 |
| UCACAAAUAUGGCCUUGUAGCCC | 1179 | usCfsacaAfaUfAfuggcCfuUfguagcscsc | 2275 | antis | 23 |

-continued

| Unmodified sequence | SEQ ID NO: | Modified sequence | SEQ ID NO: | strand | Length |
|---|---|---|---|---|---|
| CUACAAGGCCAUAUUUGUGAC | 1180 | csusacaaGfgCfCfAfuauuugugacL96 | 2276 | sense | 21 |
| GUCACAAAUAUGGCCUUGUAGCC | 1181 | gsUfscacAfaAfUfauggCfcUfuguagscsc | 2277 | antis | 23 |
| AUGGGCUACAAGGCCAUAUUU | 1182 | asusgggCfuaCfAfAfggccauauuuL96 | 2278 | sense | 21 |
| AAAUAUGGCCUUGUAGCCCAUCU | 1183 | asAfsauaUfgGfCfcuugUfaGfcccauscsu | 2279 | antis | 23 |
| GAUGGGCUACAAGGCCAUAUU | 1184 | gsasugggCfuAfCfAfaggccauauuL96 | 2280 | sense | 21 |
| AAUAUGGCCUUGUAGCCCAUCUU | 1185 | asAfsuauGfgCfCfuuguAfgCfccaucsusu | 2281 | antis | 23 |
| ACUGGAGAGAAUUGGAAUGGG | 1186 | ascsuggaGfaGfAfAfuuggaaugggL96 | 2282 | sense | 21 |
| CCCAUUCCAAUUCUCUCCAGUGC | 1187 | csCfscauUfcCfAfauucUfcUfccagusgsc | 2283 | antis | 23 |
| CUGGAGAGAAUUGGAAUGGGU | 1188 | csusggagAfgAfAfUfuggaaugggUL96 | 2284 | sense | 21 |
| ACCCAUUCCAAUUCUCUCCAGUG | 1189 | asCfsccaUfuCfCfaauuCfuCfuccagsusg | 2285 | antis | 23 |
| UAGCACUGGAGAGAAUUGGAA | 1190 | usasgcacUfgGfAfGfagaauuggaaL96 | 2286 | sense | 21 |
| UUCCAAUUCUCUCCAGUGCUACC | 1191 | usUfsccaAfuUfCfucucCfaGfugcuascsc | 2287 | antis | 23 |
| GUAGCACUGGAGAGAAUUGGA | 1192 | gsusagcaCfuGfGfAfgagaauuggaL96 | 2288 | sense | 21 |
| UCCAAUUCUCUCCAGUGCUACCU | 1193 | usCfscaaUfuCfUfcuccAfgUfgcuacscsu | 2289 | antis | 23 |
| ACAGUGGACACACCUUACCUG | 1194 | ascsagugGfaCfAfCfaccuuaccugL96 | 2290 | sense | 21 |
| CAGGUAAGGUGUGUCCACUGUCA | 1195 | csAfsgguAfaGfGfugugUfcCfacuguscsa | 2291 | antis | 23 |
| CAGUGGACACACCUUACCUGG | 1196 | csasguggAfcCfAfCfaccuuaccuggL96 | 2292 | sense | 21 |
| CCAGGUAAGGUGUGUCCACUGUC | 1197 | csCfsaggUfaAfGfgugUfGfuCfcacugsusc | 2293 | antis | 23 |
| UGUGACAGUGGACACACCUUA | 1198 | usgsugacAfgUfGfGfacacaccuuaL96 | 2294 | sense | 21 |
| UAAGGUGUGUCCACUGUCACAAA | 1199 | usAfsaggUfgUfGfuccaCfuGfucacasasa | 2295 | antis | 23 |
| UUGUGACAGUGGACACACCUU | 1200 | ususugaCfaGfUfGfgacacaccuuL96 | 2296 | sense | 21 |
| AAGGUGUGUCCACUGUCACAAAU | 1201 | asAfsgguGfuGfUfccacUfgUfcacaasasu | 2297 | antis | 23 |
| GAAGACUGACAUCAUUGCCAA | 1202 | gsasagacUfgAfCfAfucauugccaaL96 | 2298 | sense | 21 |
| UUGGCAAUGAUGUCAGUCUUCUC | 1203 | usUfsggcAfaUfGfauguCfaGfucuucsusc | 2299 | antis | 23 |
| AAGACUGACAUCAUUGCCAAU | 1204 | asasgacuGfaCfAfAfUfcauugccaauL96 | 2300 | sense | 21 |
| AUUGGCAAUGAUGUCAGUCUUCU | 1205 | asUfsuggCfaAfUfgaugUfcAfgucuuscsu | 2301 | antis | 23 |
| CUGAAGACUGACAUCAUUG | 1206 | csusgaagAfgAfCfUfgacaucauugL96 | 2302 | sense | 21 |
| CAAUGAUGUCAGUCUUCUCAGCC | 1207 | csAfsaugAfuGfUfcaguCfuUfcucagscsc | 2303 | antis | 23 |
| GCUGAGAAGACUGACAUCAUU | 1208 | gscsugagAfaGfAfCfugacaucauuL96 | 2304 | sense | 21 |
| AAUGAUGUCAGUCUUCUCAGCCA | 1209 | asAfsugaUfgUfCfagucUfuCfucagcscsa | 2305 | antis | 23 |
| GCUCAGGUUCAAAGUGUUGGU | 1210 | gscsucagGfuUfCfAfaaguguugguL96 | 2306 | sense | 21 |
| ACCAACACUUUGAACCUGAGCUU | 1211 | asCfscaaCfaCfUfuugaAfcCfugagcsusu | 2307 | antis | 23 |
| CUCAGGUUCAAAGUGUUGGUA | 1212 | csuscaggUfuCfAfAfaguguugguaL96 | 2308 | sense | 21 |
| UACCAACACUUUGAACCUGAGCU | 1213 | usAfsccaAfcAfCfuuugAfaCfcugagscsu | 2309 | antis | 23 |
| GUAAGCUCAGGUUCAAAGUGU | 1214 | gsusaagcUfcAfGfGfuucaaaguguL96 | 2310 | sense | 21 |
| ACACUUUGAACCUGAGCUUACAA | 1215 | asCfsacuUfuGfAfaccuGfaGfcuuacsasa | 2311 | antis | 23 |
| UGUAAGCUCAGGUUCAAAGUG | 1216 | usgsuaagCfuCfAfGfguucaaagugL96 | 2312 | sense | 21 |
| CACUUUGAACCUGAGCUUACAAU | 1217 | csAfscuuUfgAfAfccugAfgCfuuacasasu | 2313 | antis | 23 |

-continued

| Unmodified sequence | SEQ ID NO: | Modified sequence | SEQ ID NO: | strand | Length |
|---|---|---|---|---|---|
| AUGUAUUACUUGACAAAGAGA | 1218 | asusguauUfaCfUfUfgacaaagagaL96 | 2314 | sense | 21 |
| UCUCUUUGUCAAGUAAUACAUGC | 1219 | usCfsucuUfuGfUfcaagUfaAfuacausgsc | 2315 | antis | 23 |
| UGUAUUACUUGACAAAGAGAC | 1220 | usgsuauuAfcUfUfGfacaaagagacL96 | 2316 | sense | 21 |
| GUCUCUUUGUCAAGUAAUACAUG | 1221 | gsUfscucUfuUfGfucaaGfuAfauacasusg | 2317 | antis | 23 |
| CAGCAUGUAUUACUUGACAAA | 1222 | csasgcauGfuAfUfUfacuugacaaaL96 | 2318 | sense | 21 |
| UUUGUCAAGUAAUACAUGCUGAA | 1223 | usUfsuguCfaAfGfuaauAfcAfugcugsasa | 2319 | antis | 23 |
| UCAGCAUGUAUUACUUGACAA | 1224 | uscsagcaUfgUfAfUfuacuugacaaL96 | 2320 | sense | 21 |
| UUGUCAAGUAAUACAUGCUGAAA | 1225 | usUfsgucAfaGfUfaauaCfaUfgcugasasa | 2321 | antis | 23 |
| CUGCAACUGUAUAUCUACAAG | 1226 | csusgcaaCfuGfUfAfuaucuacaagL96 | 2322 | sense | 21 |
| CUUGUAGAUAUACAGUUGCAGCC | 1227 | csUfsuguAfgAfUfauacAfgUfugcagscsc | 2323 | antis | 23 |
| UGCAACUGUAUAUCUACAAGG | 1228 | usgscaacUfgUfAfUfaucuacaaggL96 | 2324 | sense | 21 |
| CCUUGUAGAUAUACAGUUGCAGC | 1229 | csCfsuugUfaGfAfuauaCfaGfuugcasgsc | 2325 | antis | 23 |
| UUGGCUGCAACUGUAUAUCUA | 1230 | ususgcuGfcAfAfCfuguauaucuaL96 | 2326 | sense | 21 |
| UAGAUAUACAGUUGCAGCCAACG | 1231 | usAfsgauAfuAfCfaguuGfcAfgccaascsg | 2327 | antis | 23 |
| GUUGGCUGCAACUGUAUAUCU | 1232 | gsusuggcUfgCfAfAfcuguauaucuL96 | 2328 | sense | 21 |
| AGAUAUACAGUUGCAGCCAACGA | 1233 | asGfsauaUfaCfAfguugCfaGfccaacsgsa | 2329 | antis | 23 |
| CAAAUGAUGAAGAAACUUUGG | 1234 | csasaaugAfuGfAfAfgaaacuuuggL96 | 2330 | sense | 21 |
| CCAAAGUUUCUUCAUCAUUUGCC | 1235 | csCfsaaaGfuUfUfcuucAfuCfauuugscsc | 2331 | antis | 23 |
| AAAUGAUGAAGAAACUUUGGC | 1236 | asasaugaUfgAfAfGfaaacuuuggcL96 | 2332 | sense | 21 |
| GCCAAAGUUUCUUCAUCAUUUGC | 1237 | gsCfscaaAfgUfUfucuuCfaUfcauuusgsc | 2333 | antis | 23 |
| GGGGCAAAUGAUGAAGAAACU | 1238 | gsgsggcaAfaUfGfAfugaagaaacuL96 | 2334 | sense | 21 |
| AGUUUCUUCAUCAUUUGCCCCAG | 1239 | asGfsuuuCfuUfCfaucaUfuUfgccccsasg | 2335 | antis | 23 |
| UGGGGCAAAUGAUGAAGAAAC | 1240 | usgsgggcAfaAfUfGfaugaagaaacL96 | 2336 | sense | 21 |
| GUUUCUUCAUCAUUUGCCCCAGA | 1241 | gsUfsuucUfuCfAfucauUfuGfccccasgsa | 2337 | antis | 23 |
| CAAAGGGUGUCGUUCUUUUCC | 1242 | csasaaggGfuGfUfCfguucuuuuccL96 | 2338 | sense | 21 |
| GGAAAAGAACGACACCCUUUGUA | 1243 | gsGfsaaaAfgAfAfcgacAfcCfcuuugsusa | 2339 | antis | 23 |
| AAAGGGUGUCGUUCUUUUCCA | 1244 | asasagggUfgUfCfGfuucuuuuccaL96 | 2340 | sense | 21 |
| UGGAAAAGAACGACACCCUUUGU | 1245 | usGfsgaaAfaGfAfacgaCfaCfccuuusgsu | 2341 | antis | 23 |
| AAUACAAAGGGUGUCGUUCUU | 1246 | asasuacaAfaGfGfGfugucguucuuL96 | 2342 | sense | 21 |
| AAGAACGACACCCUUUGUAUUGA | 1247 | asAfsgaaCfgAfCfacccUfuUfguauusgsa | 2343 | antis | 23 |
| CAAUACAAAGGGUGUCGUUCU | 1248 | csasauacAfaAfGfGfgugucguucuL96 | 2344 | sense | 21 |
| AGAACGACACCCUUUGUAUUGAA | 1249 | asGfsaacGfaCfAfcccuUfuGfuauugsasa | 2345 | antis | 23 |
| AAAGGCACUGAUGUUCUGAAA | 1250 | asasaggcAfcUfGfAfuguucugaaaL96 | 2346 | sense | 21 |
| UUUCAGAACAUCAGUGCCUUUCC | 1251 | usUfsucaGfaAfCfaucaGfuGfccuuuscsc | 2347 | antis | 23 |
| AAGGCACUGAUGUUCUGAAAG | 1252 | asasggcaCfuGfAfUfguucugaaagL96 | 2348 | sense | 21 |
| CUUUCAGAACAUCAGUGCCUUUC | 1253 | csUfsuucAfgAfAfcaucAfgUfgccuususc | 2349 | antis | 23 |
| GCGGAAAGGCACUGAUGUUCU | 1254 | gscsggaaAfgGfCfAfcugauguucuL96 | 2350 | sense | 21 |
| AGAACAUCAGUGCCUUUCCGCAC | 1255 | asGfsaacAfuCfAfgugcCfuUfuccgcsasc | 2351 | antis | 23 |

| Unmodified sequence | SEQ ID NO: | Modified sequence | SEQ ID NO: | strand | Length |
|---|---|---|---|---|---|
| UGCGGAAAGGCACUGAUGUUC | 1256 | usgscggaAfaGfGfCfacugauguucL96 | 2352 | sense | 21 |
| GAACAUCAGUGCCUUUCCGCACA | 1257 | gsAfsacaUfcAfGfugccUfuUfccgcascsa | 2353 | antis | 23 |
| AAGGAUGCUCCGGAAUGUUGC | 1258 | asasggauGfcUfCfCfggaauguugcL96 | 2354 | sense | 21 |
| GCAACAUUCCGGAGCAUCCUUGG | 1259 | gsCfsaacAfuUfCfcggaGfcAfuccuusgsg | 2355 | antis | 23 |
| AGGAUGCUCCGGAAUGUUGCU | 1260 | asgsgaugCfuCfCfGfgaauguugcuL96 | 2356 | sense | 21 |
| AGCAACAUUCCGGAGCAUCCUUG | 1261 | asGfscaaCfaUfUfccggAfgCfauccususg | 2357 | antis | 23 |
| AUCCAAGGAUGCUCCGGAAUG | 1262 | asusccaaGfgAfUfGfcuccggaaugL96 | 2358 | sense | 21 |
| CAUUCCGGAGCAUCCUUGGAUAC | 1263 | csAfsuucCfgGfAfgcauCfcUfuggausasc | 2359 | antis | 23 |
| UAUCCAAGGAUGCUCCGGAAU | 1264 | usasuccaAfgGfAfUfgcuccggaauL96 | 2360 | sense | 21 |
| AUUCCGGAGCAUCCUUGGAUACA | 1265 | asUfsuccGfgAfGfcaucCfuUfggauascsa | 2361 | antis | 23 |
| AAUGGGUGGCGGUAAUUGGUG | 1266 | asasugggUfgGfCfGfguaauuggugL96 | 2362 | sense | 21 |
| CACCAAUUACCGCCACCCAUUCC | 1267 | csAfsccaAfuUfAfccgcCfaCfccauuscsc | 2363 | antis | 23 |
| AUGGGUGGCGGUAAUUGGUGA | 1268 | asusggguGfgCfGfGfuaauugguggaL96 | 2364 | sense | 21 |
| UCACCAAUUACCGCCACCCAUUC | 1269 | usCfsaccAfaUfUfaccgCfcAfcccaususc | 2365 | antis | 23 |
| UUGGAAUGGGUGGCGGUAAUU | 1270 | ususggaaUfgGfGfUfggcgguaauuL96 | 2366 | sense | 21 |
| AAUUACCGCCACCCAUUCCAAUU | 1271 | asAfsuuaCfcGfCfcaccCfaUfuccaasusu | 2367 | antis | 23 |
| AUUGGAAUGGGUGGCGGUAAU | 1272 | asusuggaAfuGfGfGfuggcgguaauL96 | 2368 | sense | 21 |
| AUUACCGCCACCCAUUCCAAUUC | 1273 | asUfsuacCfgCfCfacccAfuUfccaasusuc | 2369 | antis | 23 |
| GGAAAGGCACUGAUGUUCUGA | 1274 | gsgsaaagGfcAfCfUfgauguucugaL96 | 2370 | sense | 21 |
| UCAGAACAUCAGUGCCUUUCCGC | 1275 | usCfsagaAfcAfUfcaguGfcCfuuuccsgsc | 2371 | antis | 23 |
| GAAAGGCACUGAUGUUCUGAA | 1276 | gsasaaggCfaCfUfGfauguucugaaL96 | 2372 | sense | 21 |
| UUCAGAACAUCAGUGCCUUUCCG | 1277 | usUfscagAfaCfAfucagUfgCfcuuucscsg | 2373 | antis | 23 |
| GUGCGGAAAGGCACUGAUGUU | 1278 | gsusgcggAfaAfGfGfcacugauguuL96 | 2374 | sense | 21 |
| AACAUCAGUGCCUUUCCGCACAC | 1279 | asAfscauCfaGfUfgccuUfcCfcgcacsasc | 2375 | antis | 23 |
| UGUGCGGAAAGGCACUGAUGU | 1280 | usgsugcGfaAfAfGfcacugauguL96 | 2376 | sense | 21 |
| ACAUCAGUGCCUUUCCGCACACC | 1281 | asCfsaucAfgUfGfccuuUfcCfgcacascsc | 2377 | antis | 23 |
| AAUUGUAAGCUCAGGUUCAAA | 1282 | asasuuguAfaGfCfUfcagguucaaaL96 | 2378 | sense | 21 |
| UUUGAACCUGAGCUUACAAUUUA | 1283 | usUfsugaAfcCfUfgagcUfuAfcaauususa | 2379 | antis | 23 |
| AUUGUAAGCUCAGGUUCAAAG | 1284 | asusuguaAfgCfUfCfagguucaaagL96 | 2380 | sense | 21 |
| CUUUGAACCUGAGCUUACAAUUU | 1285 | csUfsuugAfaCfCfugagCfuUfacaaususu | 2381 | antis | 23 |
| CUUAAAUUGUAAGCUCAGGUU | 1286 | csusuaaaUfuGfUfAfagcucagguuL96 | 2382 | sense | 21 |
| AACCUGAGCUUACAAUUUAAGAA | 1287 | asAfsccuGfaGfCfuuacAfaUfuuaagsasa | 2383 | antis | 23 |
| UCUUAAAUUGUAAGCUCAGGU | 1288 | uscsuuaaAfuUfGfUfaagcucagguL96 | 2384 | sense | 21 |
| ACCUGAGCUUACAAUUUAAGAAC | 1289 | asCfscugAfgCfUfuacaAfuUfuaagasasc | 2385 | antis | 23 |
| GCAAACACUAAGGUGAAAAGA | 1290 | gscsaaacAfcUfAfAfggugaaaagaL96 | 2386 | sense | 21 |
| UCUUUUCACCUUAGUGUUUGCUA | 1291 | usCfsuuuUfcAfCfcuuaGfuGfuuugcsusa | 2387 | antis | 23 |
| CAAACACUAAGGUGAAAAGAU | 1292 | csasaacaCfuAfAfGfgugaaaagauL96 | 2388 | sense | 21 |
| AUCUUUUCACCUUAGUGUUUGCU | 1293 | asUfscuuUfuCfAfccuuAfgUfguuugscsu | 2389 | antis | 23 |

| Unmodified sequence | SEQ ID NO: | Modified sequence | SEQ ID NO: | strand | Length |
|---|---|---|---|---|---|
| GGUAGCAAACACUAAGGUGAA | 1294 | gsgsuagcAfaAfCfAfcuaaggugaaL96 | 2390 | sense | 21 |
| UUCACCUUAGUGUUUGCUACCUC | 1295 | usUfscacCfuUfAfguguUfuGfcuaccsusc | 2391 | antis | 23 |
| AGGUAGCAAACACUAAGGUGA | 1296 | asgsguagCfaAfAfCfacuaaggugaL96 | 2392 | sense | 21 |
| UCACCUUAGUGUUUGCUACCUCC | 1297 | usCfsaccUfuAfGfuguuUfgCfuaccuscsc | 2393 | antis | 23 |
| AGGUAGCAAACACUAAGGUGA | 1298 | asgsguagCfaAfAfCfacuaaggugaL96 | 2394 | sense | 21 |
| UCACCUUAGUGUUUGCUACCUCC | 1299 | usCfsaccUfuAfGfuguuUfgCfuaccuscsc | 2395 | antis | 23 |
| GGUAGCAAACACUAAGGUGAA | 1300 | gsgsuagcAfaAfCfAfcuaaggugaaL96 | 2396 | sense | 21 |
| UUCACCUUAGUGUUUGCUACCUC | 1301 | usUfscacCfuUfAfguguUfuGfcuaccsusc | 2397 | antis | 23 |
| UUGGAGGUAGCAAACACUAAG | 1302 | ususggagGfuAfGfCfaaacacuaagL96 | 2398 | sense | 21 |
| CUUAGUGUUUGCUACCUCCAAUU | 1303 | csUfsuagUfgUfUfugcuAfcCfuccaasusu | 2399 | antis | 23 |
| AUUGGAGGUAGCAAACACUAA | 1304 | asusuggaGfgUfAfGfcaaacacuaaL96 | 2400 | sense | 21 |
| UUAGUGUUUGCUACCUCCAAUUU | 1305 | usUfsaguGfuUfUfgcuaCfcUfccaaususu | 2401 | antis | 23 |
| UAAAGUGCUGUAUCCUUUAGU | 1306 | usasaaguGfcUfGfUfauccuuuaguL96 | 2402 | sense | 21 |
| ACUAAAGGAUACAGCACUUUAGC | 1307 | asCfsuaaAfgGfAfuacaGfcAfcuuuasgsc | 2403 | antis | 23 |
| AAAGUGCUGUAUCCUUUAGUA | 1308 | asasagugCfuGfUfAfuccuuuaguaL96 | 2404 | sense | 21 |
| UACUAAAGGAUACAGCACUUUAG | 1309 | usAfscuaAfaGfGfauacAfgCfacuuusasg | 2405 | antis | 23 |
| AGGCUAAAGUGCUGUAUCCUU | 1310 | asgsgcuaAfaGfUfGfcuguauccuuL96 | 2406 | sense | 21 |
| AAGGAUACAGCACUUUAGCCUGC | 1311 | asAfsggaUfaCfAfgcacUfuUfagccusgsc | 2407 | antis | 23 |
| CAGGCUAAAGUGCUGUAUCCU | 1312 | csasggcuAfaAfGfUfgcuguauccuL96 | 2408 | sense | 21 |
| AGGAUACAGCACUUUAGCCUGCC | 1313 | asGfsgauAfcAfGfcacuUfuAfgccugscsc | 2409 | antis | 23 |
| AAGACAUUGGUGAGGAAAAAU | 1314 | asasagacaUfuGfGfUfgaggaaaaauL96 | 2410 | sense | 21 |
| AUUUUUCCUCACCAAUGUCUUGU | 1315 | asUfsuuuUfcCfUfcaccAfaUfgucuusgsu | 2411 | antis | 23 |
| AGACAUUGGUGAGGAAAAAUC | 1316 | asgsacauUfgGfUfGfaggaaaaaucL96 | 2412 | sense | 21 |
| GAUUUUUCCUCACCAAUGUCUUG | 1317 | gsAfsuuuUfuCfCfucacCfaAfugucususg | 2413 | antis | 23 |
| CGACAAGACAUUGGUGAGGAA | 1318 | csgsacaaGfaCfAfUfugguaggaaL96 | 2414 | sense | 21 |
| UUCCUCACCAAUGUCUUGUCGAU | 1319 | usUfsccuCfaCfCfaaugUfcUfugucgsasu | 2415 | antis | 23 |
| UCGACAAGACAUUGGUGAGGA | 1320 | uscsgacaAfgAfCfAfuuggugaggaL96 | 2416 | sense | 21 |
| UCCUCACCAAUGUCUUGUCGAUG | 1321 | usCfscucAfcCfAfauguCfuUfgucgasusg | 2417 | antis | 23 |
| AAGAUGUCCUCGAGAUACUAA | 1322 | asasgaugUfcCfUfCfgagauacuaaL96 | 2418 | sense | 21 |
| UUAGUAUCUCGAGGACAUCUUGA | 1323 | usUfsaguAfuCfUfcgagGfaCfaucuusgsa | 2419 | antis | 23 |
| AGAUGUCCUCGAGAUACUAAA | 1324 | asgsauguCfcUfCfGfagauacuaaaL96 | 2420 | sense | 21 |
| UUUAGUAUCUCGAGGACAUCUUG | 1325 | usUfsuagUfaUfCfucgaGfgAfcaucususg | 2421 | antis | 23 |
| GUUCAAGAUGUCCUCGAGAUA | 1326 | gsusucaaGfaUfGfUfccucgagauaL96 | 2422 | sense | 21 |
| UAUCUCGAGGACAUCUUGAACAC | 1327 | usAfsucuCfgAfGfgacaUfcUfugaacsasc | 2423 | antis | 23 |
| UGUUCAAGAUGUCCUCGAGAU | 1328 | usgsuucaAfgAfUfGfuccucgagauL96 | 2424 | sense | 21 |
| AUCUCGAGGACAUCUUGAACACC | 1329 | asUfscucGfaGfGfacauCfuUfgaacascsc | 2425 | antis | 23 |
| GAGAAAGGUGUUCAAGAUGUC | 1330 | gsasgaaaGfgUfGfUfucaagaugucL96 | 2426 | sense | 21 |
| GACAUCUUGAACACCUUUCUCCC | 1331 | gsAfscauCfuUfGfaacaCffcUfuucucscsc | 2427 | antis | 23 |

| Unmodified sequence | SEQ ID NO: | Modified sequence | SEQ ID NO: | strand | Length |
|---|---|---|---|---|---|
| AGAAAGGUGUUCAAGAUGUCC | 1332 | asgsaaagGfuGfUfUfcaagauguccL96 | 2428 | sense | 21 |
| GGACAUCUUGAACACCUUUCUCC | 1333 | gsGfsacaUfcUfUfgaacAfcCfuuucucscsc | 2429 | antis | 23 |
| GGGGGAGAAAGGUGUUCAAGA | 1334 | gsgsgggaGfaAfAfGfguguucaagaL96 | 2430 | sense | 21 |
| UCUUGAACACCUUUCUCCCCUG | 1335 | usCfsuugAfaCfAfccuuUfcUfcccccsusg | 2431 | antis | 23 |
| AGGGGGAGAAAGGUGUUCAAG | 1336 | asgsggggAfgAfAfAfgguguucaagL96 | 2432 | sense | 21 |
| CUUGAACACCUUUCUCCCCUGG | 1337 | csUfsugaAfcAfCfcuuuCfuCfccccusgsg | 2433 | antis | 23 |
| GCUGGGAAGAUAUCAAAUGGC | 1338 | gscsugggAfaGfAfUfaucaaauggcL96 | 2434 | sense | 21 |
| GCCAUUUGAUAUCUUCCCAGCUG | 1339 | gsCfscauUfuGfAfuaucUfuCfccagcsusg | 2435 | antis | 23 |
| CUGGGAAGAUAUCAAAUGGCU | 1340 | csusgggaAfgAfUfAfucaaauggcuL96 | 2436 | sense | 21 |
| AGCCAUUUGAUAUCUUCCCAGCU | 1341 | asGfsccaUfuUfGfauauCfuUfcccagscsu | 2437 | antis | 23 |
| AUCAGCUGGGAAGAUAUCAAA | 1342 | asuscagCfUfgGfGfAfagauaucaaaL96 | 2438 | sense | 21 |
| UUUGAUAUCUUCCCAGCUGAUAG | 1343 | usUfsugaUfaUfCfuuccCfaGfcugausasg | 2439 | antis | 23 |
| UAUCAGCUGGGAAGAUAUCAA | 1344 | usasucagCfuGfGfGfaagauaucaaL96 | 2440 | sense | 21 |
| UUGAUAUCUUCCCAGCUGAUAGA | 1345 | usUfsgauAfuCfUfucccAfgCfugauasgsa | 2441 | antis | 23 |
| UCUGUCGACUUCUGUUUUAGG | 1346 | uscsugucGfaCfUfUfcuguuuuaggL96 | 2442 | sense | 21 |
| CCUAAAACAGAAGUCGACAGAUC | 1347 | csCfsuaaAfaCfAfgaagUfcGfacagasusc | 2443 | antis | 23 |
| CUGUCGACUUCUGUUUUAGGA | 1348 | csusgucgAfcUfUfCfuguuuuaggaL96 | 2444 | sense | 21 |
| UCCUAAAACAGAAGUCGACAGAU | 1349 | usCfscuaAfaAfCfagaaGfuCfgacagsasu | 2445 | antis | 23 |
| CAGAUCUGUCGACUUCUGUUU | 1350 | csasgaucUfgUfCfGfacuucuguuuL96 | 2446 | sense | 21 |
| AAACAGAAGUCGACAGAUCUGUU | 1351 | asAfsacaGfaAfGfucgaCfaGfaucugsusu | 2447 | antis | 23 |
| ACAGAUCUGUCGACUUCUGUU | 1352 | ascsagauCfuGfUfCfgacuucuguuL96 | 2448 | sense | 21 |
| AACAGAAGUCGACAGAUCUGUUU | 1353 | asAfscagAfaGfUfcgacAfgAfucugususu | 2449 | antis | 23 |
| UACUUCUUUGAAUGUAGAUUU | 1354 | usascuucUfuUfGfAfauguagauuuL96 | 2450 | sense | 21 |
| AAAUCUACAUUCAAAGAAGUAUC | 1355 | asAfsaucUfaCfAfuucaAfaGfaaguasusc | 2451 | antis | 23 |
| ACUUCUUUGAAUGUAGAUUUC | 1356 | ascsuucuUfuGfAfAfuguagauuucL96 | 2452 | sense | 21 |
| GAAAUCUACAUUCAAAGAAGUAU | 1357 | gsAfsaauCfuAfCfauucAfaAfgaagusasu | 2453 | antis | 23 |
| GUGAUACUUCUUUGAAUGUAG | 1358 | gsusgauaCfuUfCfUfuugaauguagL96 | 2454 | sense | 21 |
| CUACAUUCAAAGAAGUAUCACCA | 1359 | csUfsacaUfuCfAfaagaAfgUfaucacscsa | 2455 | antis | 23 |
| GGUGAUACUUCUUUGAAUGUA | 1360 | gsgsugauAfcUfUfCfuuugaauguaL96 | 2456 | sense | 21 |
| UACAUUCAAAGAAGUAUCACCAA | 1361 | usAfscauUfcAfAfagaaGfuAfucaccsasa | 2457 | antis | 23 |
| UGGGAAGAUAUCAAAUGGCUG | 1362 | usgsgsgaaGfaUfAfUfcaaauggcugL96 | 2458 | sense | 21 |
| CAGCCAUUUGAUAUCUUCCCAGC | 1363 | csAfsgccAfuUfUfgauaUfcUfucccasgsc | 2459 | antis | 23 |
| GGGAAGAUAUCAAAUGGCUGA | 1364 | gsgsgaagAfuAfUfCfaaauggcugaL96 | 2460 | sense | 21 |
| UCAGCCAUUUGAUAUCUUCCCAG | 1365 | usCfsagcCfaUfUfUfgauAfuCfucccsasg | 2461 | antis | 23 |
| CAGCUGGGAAGAUAUCAAAUG | 1366 | csasgcugGfgAfAfGfauaucaaaugL96 | 2462 | sense | 21 |
| CAUUUGAUAUCUUCCCAGCUGAU | 1367 | csAfsuuuGfaUfAfucuuCfcCfagcugsasu | 2463 | antis | 23 |
| UCAGCUGGGAAGAUAUCAAAU | 1368 | uscsagcuGfgGfAfAfgauaucaaauL96 | 2464 | sense | 21 |
| AUUUGAUAUCUUCCCAGCUGAUA | 1369 | asUfsuugAfuAfUfcuucCfcCfagcugasusa | 2465 | antis | 23 |

| Unmodified sequence | SEQ ID NO: | Modified sequence | SEQ ID NO: | strand | Length |
|---|---|---|---|---|---|
| UCCAAAGUCUAUAUAUGACUA | 1370 | uscscaaaGfuCfUfAfuauaugacuaL96 | 2466 | sense | 21 |
| UAGUCAUAUAUAGACUUUGGAAG | 1371 | usAfsgucAfuAfUfauagAfcUfuuggasasg | 2467 | antis | 23 |
| CCAAAGUCUAUAUAUGACUAU | 1372 | cscsaaagUfcUfAfUfauaugacuauL96 | 2468 | sense | 21 |
| AUAGUCAUAUAUAGACUUUGGAA | 1373 | asUfsaguCfaUfAfuauaGfaCfuuuggsasa | 2469 | antis | 23 |
| UACUUCCAAAGUCUAUAUAUG | 1374 | usascuucCfaAfAfGfucuauauaugL96 | 2470 | sense | 21 |
| CAUAUAUAGACUUUGGAAGUACU | 1375 | csAfsuauAfuAfUfGfacuuUfgGfaaguascsu | 2471 | antis | 23 |
| GUACUUCCAAAGUCUAUAUAU | 1376 | gsusacuuCfcAfAfAfgucuauauauL96 | 2472 | sense | 21 |
| AUAUAUAGACUUUGGAAGUACUG | 1377 | asUfsauaUfaGfAfAfcuuuGfgAfaguacsusg | 2473 | antis | 23 |
| UUAUGAACAACAUGCUAAAUC | 1378 | ususaugaAfcAfAfCfaugcuaaaucL96 | 2474 | sense | 21 |
| GAUUUAGCAUGUUGUUCAUAAUC | 1379 | gsAfsuuuAfgCfAfuguuGfuUfcauaasusc | 2475 | antis | 23 |
| UAUGAACAACAUGCUAAAUCA | 1380 | usasugaaCfaAfCfAfugcuaaaucaL96 | 2476 | sense | 21 |
| UGAUUUAGCAUGUUGUUCAUAAU | 1381 | usGfsauuUfaGfCfauguUfgUfucauasasu | 2477 | antis | 23 |
| AUGAUUAUGAACAACAUGCUA | 1382 | asusgauuAfuGfAfAfcaacaugcuaL96 | 2478 | sense | 21 |
| UAGCAUGUUGUUCAUAAUCAUUG | 1383 | usAfsgcaUfgUfUfguucAfuAfaucaususg | 2479 | antis | 23 |
| AAUGAUUAUGAACAACAUGCU | 1384 | asasugauUfaUfGfAfacaacaugcuL96 | 2480 | sense | 21 |
| AGCAUGUUGUUCAUAAUCAUUGA | 1385 | asGfscauUfuGfUfuucaUfaAfucauusgsa | 2481 | antis | 23 |
| AAUUCCCCACUUCAAUACAAA | 1386 | asasuuccCfcAfCfUfucaauacaaaL96 | 2482 | sense | 21 |
| UUUGUAUUGAAGUGGGGAAUUAC | 1387 | usUfsuguAfuUfGfaaguGfgGfgaauusasc | 2483 | antis | 23 |
| AUUCCCCACUUCAAUACAAAG | 1388 | asusucccCfaCfUfUfcaauacaaagL96 | 2484 | sense | 21 |
| CUUUGUAUUGAAGUGGGGAAUUA | 1389 | csUfsuugUfaUfUfgaagUfgGfggaaususa | 2485 | antis | 23 |
| CUGUAAUUCCCCACUUCAAUA | 1390 | csusguaaUfuCfCfCfcacuucaauaL96 | 2486 | sense | 21 |
| UAUUGAAGUGGGGAAUUACAGAC | 1391 | usAfsuugAfaGfUfggggAfaUfuacagsasc | 2487 | antis | 23 |
| UCUGUAAUUCCCCACUUCAAU | 1392 | uscsguaAfuUfCfCfccacuucaauL96 | 2488 | sense | 21 |
| AUUGAAGUGGGGAAUUACAGACU | 1393 | asUfsugaAfgUfGfgggaAfuUfacagascsu | 2489 | antis | 23 |
| UGAUGUGCGUAACAGAUUCAA | 1394 | usgsauguGfcGfUfAfacagauucaaL96 | 2490 | sense | 21 |
| UUGAAUCUGUUACGCACAUCAUC | 1395 | usUfsgaaUfcUfGfuuacGfcAfcaucasusc | 2491 | antis | 23 |
| GAUGUGCGUAACAGAUUCAAA | 1396 | gsasugugCfgUfAfAfcagauucaaaL96 | 2492 | sense | 21 |
| UUUGAAUCUGUUACGCACAUCAU | 1397 | usUfsugaAfuCfUfguuaCfgCfacaucsasu | 2493 | antis | 23 |
| UGGAUGAUGUGCGUAACAGAU | 1398 | usgsgaugAfuGfUfGfcguaacagauL96 | 2494 | sense | 21 |
| AUCUGUUACGCACAUCAUCCAGA | 1399 | asUfscugUfuAfCfgcacAfuCfauccasgsa | 2495 | antis | 23 |
| CUGGAUGAUGUGCGUAACAGA | 1400 | csusggauGfaUfGfUfgcguaacagaL96 | 2496 | sense | 21 |
| UCUGUUACGCACAUCAUCCAGAC | 1401 | usCfsuguUfaCfGfcacaUfcAfuccagsasc | 2497 | antis | 23 |
| GAAUGGGUGGCGGUAAUUGGU | 1402 | gsasauggGfuGfGfCfgguaauugguL96 | 2498 | sense | 21 |
| ACCAAUUACCGCCACCCAUUCCA | 1403 | asCfscaaUfuAfCfgccAfcCfcauucscsa | 2499 | antis | 23 |
| AAUGGGUGGCGGUAAUUGGUG | 1404 | asasugggUfgGfCfGfguaauuggugL96 | 2500 | sense | 21 |
| CACCAAUUACCGCCACCCAUUCC | 1405 | csAfsccaAfuUfAfccgcCfaCfccauuscsc | 2501 | antis | 23 |
| AUGGAAUGGGUGGCGGUAAU | 1406 | asusuggaAfuGfGfGfuggcgguaauL96 | 2502 | sense | 21 |
| AUUACCGCCACCCAUUCCAAUUC | 1407 | asUfsuacCfgCfCfacccAfuUfccaaususc | 2503 | antis | 23 |

| Unmodified sequence | SEQ ID NO: | Modified sequence | SEQ ID NO: | strand | Length |
|---|---|---|---|---|---|
| AAUUGGAAUGGGUGGCGGUAA | 1408 | asasuuggAfaUfGfGfguggcgguaaL96 | 2504 | sense | 21 |
| UUACCGCCACCCAUUCCAUUCU | 1409 | usUfsaccGfcCfAfcccaUfuCfcaauucsu | 2505 | antis | 23 |
| UCCGGAAUGUUGCUGAAACAG | 1410 | uscscggaAfuGfUfUfgcugaaacagL96 | 2506 | sense | 21 |
| CUGUUUCAGCAACAUUCCGGAGC | 1411 | csUfsguuUfcAfGfcaacAfuUfccggasgsc | 2507 | antis | 23 |
| CCGGAAUGUUGCUGAAACAGA | 1412 | cscsggaaUfgUfUfGfcugaaacagaL96 | 2508 | sense | 21 |
| UCUGUUUCAGCAACAUUCCGGAG | 1413 | usCfsuguUfuCfAfgcaaCfaUfuccggsasg | 2509 | antis | 23 |
| AUGCUCCGGAAUGUUGCUGAA | 1414 | asusgcucCfgGfAfAfuguugcugaaL96 | 2510 | sense | 21 |
| UUCAGCAACAUUCCGGAGCAUCC | 1415 | usUfscagCfaAfCfauucCfgGfagcauscsc | 2511 | antis | 23 |
| GAUGCUCCGGAAUGUUGCUGA | 1416 | gsasugcuCfcGfGfAfauguugcugaL96 | 2512 | sense | 21 |
| UCAGCAACAUUCCGGAGCAUCCU | 1417 | usCfsagcAfaCfAfuuccGfgAfgcaucscsu | 2513 | antis | 23 |
| UGUCCUCGAGAUACUAAAGGA | 1418 | usgsuccuCfgAfGfAfuacuaaaggaL96 | 2514 | sense | 21 |
| UCCUUUAGUAUCUCGAGGACAUC | 1419 | usCfscuuUfaGfUfaucuCfgAfggacasusc | 2515 | antis | 23 |
| GUCCUCGAGAUACUAAAGGAA | 1420 | gsusccucGfaGfAfUfacuaaaggaaL96 | 2516 | sense | 21 |
| UUCCUUUAGUAUCUCGAGGACAU | 1421 | usUfsccuUfuAfGfuaucUfcGfaggacsasu | 2517 | antis | 23 |
| AAGAUGUCCUCGAGAUACUAA | 1422 | asasgaugUfcCfUfCfgagauacuaaL96 | 2518 | sense | 21 |
| UUAGUAUCUCGAGGACAUCUUGA | 1423 | usUfsaguAfuCfUfcgagGfaCfaucuusgsa | 2519 | antis | 23 |
| CAAGAUGUCCUCGAGAUACUA | 1424 | csasagauGfuCfCfUfcgagauacuaL96 | 2520 | sense | 21 |
| UAGUAUCUCGAGGACAUCUUGAA | 1425 | usAfsguaUfcUfCfgaggAfcAfucuugsasa | 2521 | antis | 23 |
| ACAACAUGCUAAAUCAGUACU | 1426 | ascsaacaUfgCfUfAfaaucaguacuL96 | 2522 | sense | 21 |
| AGUACUGAUUUAGCAUGUUGUUC | 1427 | asGfsuacUfgAfUfuuagCfaUfguugususc | 2523 | antis | 23 |
| CAACAUGCUAAAUCAGUACUU | 1428 | csasacauGfcUfAfAfaucaguacuuL96 | 2524 | sense | 21 |
| AAGUACUGAUUUAGCAUGUUGUU | 1429 | asAfsguaCfuGfAfuuuaGfcAfuguugsusu | 2525 | antis | 23 |
| AUGAACAACAUGCUAAAUCAG | 1430 | asusgaacAfaCfAfUfgcuaaaucagL96 | 2526 | sense | 21 |
| CUGAUUUAGCAUGUUGUUCAUAA | 1431 | csUfsgauUfuAfGfcaugUfuGfuucausasa | 2527 | antis | 23 |
| UAUGAACAACAUGCUAAAUCA | 1432 | usasugaaCfaAfCfAfugcuaaaucaL96 | 2528 | sense | 21 |
| UGAUUUAGCAUGUUGUUCAUAAU | 1433 | usGfsauuUfaGfCfauguUfgUfucauasasu | 2529 | antis | 23 |
| GCCAAGGCUGUGUUUGUGGGG | 1434 | gscscaagGfcUfGfUfguuugugggL96 | 2530 | sense | 21 |
| CCCCACAAACACAGCCUUGGCGC | 1435 | csCfsccaCfaAfAfcacaGfcCfuuggcsgsc | 2531 | antis | 23 |
| CCAAGGCUGUGUUUGUGGGA | 1436 | cscsaaggCfuGfUfUfuuuguggggaL96 | 2532 | sense | 21 |
| UCCCCACAAACACAGCCUUGGCG | 1437 | usCfscccAfcAfAfacacAfgCfcuuggscsg | 2533 | antis | 23 |
| UGGCGCCAAGGCUGUGUUUGU | 1438 | usgsgcgcCfaAfGfGfcuguguuuguL96 | 2534 | sense | 21 |
| ACAAACACAGCCUUGGCGCCAAG | 1439 | asCfsaaaCfaCfAfgccuUfgGfcgccasasg | 2535 | antis | 23 |
| UUGGCGCCAAGGCUGUGUUUG | 1440 | ususggcgCfcAfAfGfgcuguguuugL96 | 2536 | sense | 21 |
| CAAACACAGCCUUGGCGCCAAGA | 1441 | csAfsaacAfcAfGfccuuGfgCfgccaasgsa | 2537 | antis | 23 |
| UGAAAGCUCUGGCUCUUGGCG | 1442 | usgsaaagCfuCfUfGfgcucuuggcgL96 | 2538 | sense | 21 |
| CGCCAAGAGCCAGAGCUUUCAGA | 1443 | csGfsccaAfgAfGfccagAfgCfuuucasgsa | 2539 | antis | 23 |
| GAAAGCUCUGGCUCUUGGCGC | 1444 | gsasaagcUfcUfGfGfcucuuggcgcL96 | 2540 | sense | 21 |
| GCGCCAAGAGCCAGAGCUUUCAG | 1445 | gsCfsgccAfaGfAfgccaGfaGfcuuucsasg | 2541 | antis | 23 |

-continued

| Unmodified sequence | SEQ ID NO: | Modified sequence | SEQ ID NO: | strand | Length |
|---|---|---|---|---|---|
| GUUCUGAAAGCUCUGGCUCUU | 1446 | gsusucugAfaAfGfCfucuggcucuuL96 | 2542 | sense | 21 |
| AAGAGCCAGAGCUUUCAGAACAU | 1447 | asAfsgagCfcAfGfagcuUfuCfagaacsasu | 2543 | antis | 23 |
| UGUUCUGAAAGCUCUGGCUCU | 1448 | usgsuucuGfaAfAfGfcucuggcucuL96 | 2544 | sense | 21 |
| AGAGCCAGAGCUUUCAGAACAUC | 1449 | asGfsagcCfaGfAfgcuuUfcAfgaacasusc | 2545 | antis | 23 |
| CAGCCACUAUUGAUGUUCUGC | 1450 | csasgccaCfuAfUfUfgauguucugcL96 | 2546 | sense | 21 |
| GCAGAACAUCAAUAGUGGCUGGC | 1451 | gsCfsagaAfcAfUfcaauAfgUfggcugsgsc | 2547 | antis | 23 |
| AGCCACUAUUGAUGUUCUGCC | 1452 | asgsccacUfaUfUfGfauguucugccL96 | 2548 | sense | 21 |
| GGCAGAACAUCAAUAGUGGCUGG | 1453 | gsGfscagAfaCfAfucaaUfaGfuggcusgsg | 2549 | antis | 23 |
| GUGCCAGCCACUAUUGAUGUU | 1454 | gsusgccaGfcCfAfCfuauugauguuL96 | 2550 | sense | 21 |
| AACAUCAAUAGUGGCUGGCACCC | 1455 | asAfscauCfaAfUfagugGfcUfggcacscsc | 2551 | antis | 23 |
| GGUGCCAGCCACUAUUGAUGU | 1456 | gsgsugccAfgCfCfAfcuauugauguL96 | 2552 | sense | 21 |
| ACAUCAAUAGUGGCUGGCACCCC | 1457 | asCfsaucAfaUfAfguggCfuGfgcaccscsc | 2553 | antis | 23 |
| ACAAGGACCGAGAAGUCACCA | 1458 | ascsaaggAfcCfGfAfgaagucaccaL96 | 2554 | sense | 21 |
| UGGUGACUUCUCGGUCCUUGUAG | 1459 | usGfsgugAfcUfUfcucgGfuCfcuugusasg | 2555 | antis | 23 |
| CAAGGACCGAGAAGUCACCAA | 1460 | csasaggaCfcGfAfGfaagucaccaaL96 | 2556 | sense | 21 |
| UUGGUGACUUCUCGGUCCUUGUA | 1461 | usUfsgguGfaCfUfucucGfgUfccuugsusa | 2557 | antis | 23 |
| AUCUACAAGGACCGAGAAGUC | 1462 | asuscuacAfaGfGfAfccgagaagucL96 | 2558 | sense | 21 |
| GACUUCUCGGUCCUUGUAGAUAU | 1463 | gsAfscuuCfuCfGfguccUfuGfuagausasu | 2559 | antis | 23 |
| UAUCUACAAGGACCGAGAAGU | 1464 | usasucuaCfaAfGfGfaccgagaaguL96 | 2560 | sense | 21 |
| ACUUCUCGGUCCUUGUAGAUAUA | 1465 | asCfsuucUfcGfGfuccuUfgUfagauasusa | 2561 | antis | 23 |
| CAGAAUGUGAAAGUCAUCGAC | 1466 | csasgaauGfuGfAfAfagucaucgacL96 | 2562 | sense | 21 |
| GUCGAUGACUUUCACAUUCUGGC | 1467 | gsUfscgaUfgAfCfuuucAfcAfuucugsgsc | 2563 | antis | 23 |
| AGAAUGUGAAAGUCAUCGACA | 1468 | asgsaaugUfgAfAfAfgucaucgacaL96 | 2564 | sense | 21 |
| UGUCGAUGACUUUCACAUUCUGG | 1469 | usGfsucgAfuGfAfcuuuCfaCfauucusgsg | 2565 | antis | 23 |
| GUGCCAGAAUGUGAAAGUCAU | 1470 | gsusgccaGfaAfUfGfugaaagucauL96 | 2566 | sense | 21 |
| AUGACUUUCACAUUCUGGCACCC | 1471 | asUfsgacUfuUfCfacauUfcUfggcacscsc | 2567 | antis | 23 |
| GGUGCCAGAAUGUGAAAGUCA | 1472 | gsgsugccAfgAfAfUfgugaaagucaL96 | 2568 | sense | 21 |
| UGACUUUCACAUUCUGGCACCCA | 1473 | usGfsacuUfuCfAfcauuCfuGfgcaccscsa | 2569 | antis | 23 |
| AGAUGUCCUCGAGAUACUAAA | 1474 | asgsauguCfcUfCfGfagauacuaaaL96 | 2570 | sense | 21 |
| UUUAGUAUCUCGAGGACAUCUUG | 1475 | usUfsuagUfaUfCfucgaGfgAfcaucususg | 2571 | antis | 23 |
| GAUGUCCUCGAGAUACUAAAG | 1476 | gsasuguCfcUfCfGfAfgauacuaaagL96 | 2572 | sense | 21 |
| CUUUAGUAUCUCGAGGACAUCUU | 1477 | csUfsuuaGfuAfUfcucgAfgGfacaucsusu | 2573 | antis | 23 |
| UUCAAGAUGUCCUCGAGAUAC | 1478 | ususcaagAfuGfUfCfcucgagauacL96 | 2574 | sense | 21 |
| GUAUCUCGAGGACAUCUUGAACA | 1479 | gsUfsaucUfcGfAfggacAfuCfuugaascsa | 2575 | antis | 23 |
| GUUCAAGAUGUCCUCGAGAUA | 1480 | gsusucaaGfaUfGfUfccucgagauaL96 | 2576 | sense | 21 |
| UAUCUCGAGGACAUCUUGAACAC | 1481 | usAfsucuCfgAfGfgacaUfcUfugaacsasc | 2577 | antis | 23 |
| GUGGACUUGCUGCAUAUGUGG | 1482 | gsusggacUfuGfCfUfgcauaugugL96 | 2578 | sense | 21 |
| CCACAUAUGCAGCAAGUCCACUG | 1483 | csCfsacaUfaUfGfcagcAfaGfuccacsusg | 2579 | antis | 23 |

-continued

| Unmodified sequence | SEQ ID NO: | Modified sequence | SEQ ID NO: | strand | Length |
|---|---|---|---|---|---|
| UGGACUUGCUGCAUAUGUGGC | 1484 | usgsgacuUfgCfUfGfcauauguggcL96 | 2580 | sense | 21 |
| GCCACAUAUGCAGCAAGUCCACU | 1485 | gsCfscacAfuAfUfgcagCfaAfguccascsu | 2581 | antis | 23 |
| GACAGUGGACUUGCUGCAUAU | 1486 | gsascaguGfgAfCfUfugcugcauauL96 | 2582 | sense | 21 |
| AUAUGCAGCAAGUCCACUGUCGU | 1487 | asUfsaugCfaGfCfaaguCfcAfcugucsgsu | 2583 | antis | 23 |
| CGACAGUGGACUUGCUGCAUA | 1488 | csgsacagUfgGfAfCfuugcugcauaL96 | 2584 | sense | 21 |
| UAUGCAGCAAGUCCACUGUCGUC | 1489 | usAfsugcAfgCfAfaguCfaCfugucgsusc | 2585 | antis | 23 |
| AACCAGUACUUUAUCAUUUUC | 1490 | asasccagUfaCfUfUfuaucauuuucL96 | 2586 | sense | 21 |
| GAAAAUGAUAAAGUACUGGUUUC | 1491 | gsAfsaaaUfgAfUfaaagUfaCfgguuususc | 2587 | antis | 23 |
| ACCAGUACUUUAUCAUUUUCU | 1492 | ascscaguAfcUfUfUfaucauuuucuL96 | 2588 | sense | 21 |
| AGAAAAUGAUAAAGUACUGGUUU | 1493 | asGfsaaaAfuGfAfuaaaGfuAfcggguususu | 2589 | antis | 23 |
| UUGAAACCAGUACUUUAUCAU | 1494 | ususgaaaCfcAfGfUfacuuuaucauL96 | 2590 | sense | 21 |
| AUGAUAAAGUACUGGUUUCAAAA | 1495 | asUfsgauAfaAfGfuacuGfgUfuucaasasa | 2591 | antis | 23 |
| UUUGAAACCAGUACUUUAUCA | 1496 | ususugaaAfcCfAfGfuacuuuaucaL96 | 2592 | sense | 21 |
| UGAUAAAGUACUGGUUUCAAAAU | 1497 | usGfsauaAfaGfUfacugGfuUfucaaasasu | 2593 | antis | 23 |
| CGAGAAGUCACCAAGAAGCUA | 1498 | csgsagaaGfuCfAfCfcaagaagcuaL96 | 2594 | sense | 21 |
| UAGCUUCUUGGUGACUUCUCGGU | 1499 | usAfsgcuUfcUfUfggugAfcUfucucgsgsu | 2595 | antis | 23 |
| GAGAAGUCACCAAGAAGCUAG | 1500 | gsasgaagUfcAfCfCfaagaagcuagL96 | 2596 | sense | 21 |
| CUAGCUUCUUGGUGACUUCUCGG | 1501 | csUfsagcUfuCfUfugguGfaCfuucucsgsg | 2597 | antis | 23 |
| GGACCGAGAAGUCACCAAGAA | 1502 | gsgsaccgAfgAfAfGfucaccaagaaL96 | 2598 | sense | 21 |
| UUCUUGGUGACUUCUCGGUCCUU | 1503 | usUfscuuGfuGfGfacuuCfuCfggucsusu | 2599 | antis | 23 |
| AGGACCGAGAAGUCACCAAGA | 1504 | asgsgaccGfaGfAfAfgucaccaagaL96 | 2600 | sense | 21 |
| UCUUGGUGACUUCUCGGUCCUUG | 1505 | usCfsuugGfuGfAfcuucUfcGfguccusus | 2601 | antis | 23 |
| UCAAAGUGUUGGUAAUGCCUG | 1506 | uscsaaagUfgUfUfGfguaaugccugL96 | 2602 | sense | 21 |
| CAGGCAUUACCAACACUUUGAAC | 1507 | csAfsggcAfuUfAfccaaCfaCfuuugasasc | 2603 | antis | 23 |
| CAAAGUGUUGGUAAUGCCUGA | 1508 | csasaaguGfuUfGfGfuaaugccugaL96 | 2604 | sense | 21 |
| UCAGGCAUUACCAACACUUUGAA | 1509 | usCfsaggCfaUfUfaccaAfcAfcuuugsasa | 2605 | antis | 23 |
| AGGUUCAAAGUGUUGGUAAUG | 1510 | asgsguucAfaAfGfUfguugguaaugL96 | 2606 | sense | 21 |
| CAUUACCAACACUUUGAACCUGA | 1511 | csAfsuuaCfcAfAfcacuUfuGfaaccusgsa | 2607 | antis | 23 |
| CAGGUUCAAAGUGUUGGUAAU | 1512 | csasgguuCfaAfAfGfuguugguaauL96 | 2608 | sense | 21 |
| AUUACCAACACUUUGAACCUGAG | 1513 | asUfsuacCfaAfCfacuuUfgAfaccugsasg | 2609 | antis | 23 |
| UAUUACUUGACAAAGAGACAC | 1514 | usasuuacUfuGfAfCfaaagagacacL96 | 2610 | sense | 21 |
| GUGUCUCUUUGUCAAGUAAUACA | 1515 | gsUfsgucUfcUfUfugucAfaGfuaauascsa | 2611 | antis | 23 |
| AUUACUUGACAAAGAGACACU | 1516 | asusuacuUfgAfCfAfaagagacacuL96 | 2612 | sense | 21 |
| AGUGUCUCUUUGUCAAGUAAUAC | 1517 | asGfsuguCfuCfUfuuguCfaAfguaauascsc | 2613 | antis | 23 |
| CAUGUAUUACUUGACAAAGAG | 1518 | csasuguaUfuAfCfUfugacaaagagL96 | 2614 | sense | 21 |
| CUCUUUGUCAAGUAAUACAUGCU | 1519 | csUfscuuUfgUfCfaaguAfaUfacaugscsu | 2615 | antis | 23 |
| GCAUGUAUUACUUGACAAAGA | 1520 | gscsauguAfuUfAfCfuugacaaagaL96 | 2616 | sense | 21 |
| UCUUUGUCAAGUAAUACAUGCUG | 1521 | usCfsuuuGfuCfAfaguaAfuAfcaugcsusg | 2617 | antis | 23 |

-continued

| Unmodified sequence | SEQ ID NO: | Modified sequence | SEQ ID NO: | strand | Length |
|---|---|---|---|---|---|
| AAAGUCAUCGACAAGACAUUG | 1522 | asasagucAfuCfGfAfcaagacauugL96 | 2618 | sense | 21 |
| CAAUGUCUUGUCGAUGACUUUCA | 1523 | csAfsaugUfcUfUfgucgAfuGfacuuuscsa | 2619 | antis | 23 |
| AAGUCAUCGACAAGACAUUGG | 1524 | asasgucaUfcGfAfCfaagacauuggL96 | 2620 | sense | 21 |
| CCAAUGUCUUGUCGAUGACUUUC | 1525 | csCfsaauGfuCfUfugucGfaUfgacuususc | 2621 | antis | 23 |
| UGUGAAAGUCAUCGACAAGAC | 1526 | usgsugaaAfgUfCfAfucgacaagacL96 | 2622 | sense | 21 |
| GUCUUGUCGAUGACUUUCACAUU | 1527 | gsUfscuuGfuCfGfaugaCfuUfucacasusu | 2623 | antis | 23 |
| AUGUGAAAGUCAUCGACAAGA | 1528 | asusgugaAfaGfUfCfaucgacaagaL96 | 2624 | sense | 21 |
| UCUUGUCGAUGACUUUCACAUUC | 1529 | usCfsuugUfcGfAfugacUfuUfcacaususc | 2625 | antis | 23 |
| AUAUGUGGCUAAAGCAAUAGA | 1530 | asusauguGfcCfUfAfaagcaauagaL96 | 2626 | sense | 21 |
| UCUAUUGCUUUAGCCACAUAUGC | 1531 | usCfsuauUfgCfUfuuagCfcAfcauausgsc | 2627 | antis | 23 |
| UAUGUGGCUAAAGCAAUAGAC | 1532 | usasugugGfcUfAfAfagcaauagacL96 | 2628 | sense | 21 |
| GUCUAUUGCUUUAGCCACAUAUG | 1533 | gsUfscuaUfuGfCfuuuaGfcCfacauasusg | 2629 | antis | 23 |
| CUGCAUAUGUGGCUAAAGCAA | 1534 | csusgcauAfuGfUfGfgcuaaagcaaL96 | 2630 | sense | 21 |
| UUGCUUUAGCCACAUAUGCAGCA | 1535 | usUfsgcuUfuaAfGfccacAfuAfugcagscsa | 2631 | antis | 23 |
| GCUGCAUAUGUGGCUAAAGCA | 1536 | gscsugcaUfaUfGfUfggcuaaagcaL96 | 2632 | sense | 21 |
| UGCUUUAGCCACAUAUGCAGCAA | 1537 | usGfscuuUfaGfCfcacaUfaUfugcagcsasa | 2633 | antis | 23 |
| AGACGACAGUGGACUUGCUGC | 1538 | asgsacgaCfaGfUfGfgacuugcugcL96 | 2634 | sense | 21 |
| GCAGCAAGUCCACUGUCGUCUCC | 1539 | gsCfsagcAfaGfUfccacUfgUfcgucuscsc | 2635 | antis | 23 |
| GACGACAGUGGACUUGCUGCA | 1540 | gsascgacAfgUfGfGfacuugcugcaL96 | 2636 | sense | 21 |
| UGCAGCAAGUCCACUGUCGUCUC | 1541 | usGfscagCfaAfGfuccaCfuGfucgucsusc | 2637 | antis | 23 |
| UUGGAGACGACAGUGGACUUG | 1542 | ususggagAfcGfAfCfaguggacuugL96 | 2638 | sense | 21 |
| CAAGUCCACUGUCGUCUCCAAAA | 1543 | csAfsaguCfcAfCfuguCfGfuCfuccaasasa | 2639 | antis | 23 |
| UUUGGAGACGACAGUGGACUU | 1544 | ususuggaGfaCfGfAfcaguggacuuL96 | 2640 | sense | 21 |
| AAGUCCACUGUCGUCUCCAAAAU | 1545 | asAfsgucCfaCfUfgucgUfcUfccaaasasu | 2641 | antis | 23 |
| GGCCACCUCCUCAAUUGAAGA | 1546 | gsgsccacCfuCfCfUfcaauugaagaL96 | 2642 | sense | 21 |
| UCUUCAAUUGAGGAGGUGGCCCA | 1547 | usCfsuucAfaUfUfgaggAfgGfuggccscsa | 2643 | antis | 23 |
| GCCACCUCCUCAAUUGAAGAA | 1548 | gscscaccUfcCfUfCfaauugaagaaL96 | 2644 | sense | 21 |
| UUCUUCAAUUGAGGAGGUGGCCC | 1549 | usUfscuuCfaAfUfugagGfaGfguggcscsc | 2645 | antis | 23 |
| CCUGGGCCACCUCCUCAAUUG | 1550 | cscsugggCfcAfCfCfuccucaauugL96 | 2646 | sense | 21 |
| CAAUUGAGGAGGUGGCCCAGGAA | 1551 | csAfsauuGfaGfGfagguGfgCfccaggsasa | 2647 | antis | 23 |
| UCCUGGGCCACCUCCUCAAUU | 1552 | uscscuggGfcCfAfCfcuccucaauuL96 | 2648 | sense | 21 |
| AAUUGAGGAGGUGGCCCAGGAAC | 1553 | asAfsuugAfgGfAfggugGfcCfcaggasasc | 2649 | antis | 23 |
| UGUAUGUUACUUCUUAGAGAG | 1554 | usgsuauguUfuAfCfUfucuuagagagL96 | 2650 | sense | 21 |
| CUCUCUAAGAAGUAACAUACAUC | 1555 | csUfscucUfaAfGfaaguAfaCfauacasusc | 2651 | antis | 23 |
| GUAUGUUACUUCUUAGAGAGA | 1556 | gsusauguUfaCfUfUfcuuagagagaL96 | 2652 | sense | 21 |
| UCUCUCUAAGAAGUAACAUACAU | 1557 | usCfsucuCfuAfAfgaagUfaAfcauacsasu | 2653 | antis | 23 |
| AGGAUGUAUGUUACUUCUUAG | 1558 | asgsgaugUfaUfGfUfuacuucuuagL96 | 2654 | sense | 21 |
| CUAAGAAGUAACAUACAUCCUAA | 1559 | csUfsaagAfaGfUfaacaUfaCfauccusasa | 2655 | antis | 23 |

-continued

| Unmodified sequence | SEQ ID NO: | Modified sequence | SEQ ID NO: | strand | Length |
|---|---|---|---|---|---|
| UAGGAUGUAUGUUACUUCUUA | 1560 | usasggauGfuAfUfGfuuacuucuuaL96 | 2656 | sense | 21 |
| UAAGAAGUAACAUACAUCCUAAA | 1561 | usAfsagaAfgUfAfacauAfcAfuccuasasa | 2657 | antis | 23 |
| AAAUGUUUUAGGAUGUAUGUU | 1562 | asasauguUfUfAfGfgauguauguuL96 | 2658 | sense | 21 |
| AACAUACAUCCUAAAACAUUUGG | 1563 | asAfscauAfcAfUfccuaAfaAfcauuusgsg | 2659 | antis | 23 |
| AAUGUUUUAGGAUGUAUGUUA | 1564 | asasuguuUfuAfGfGfauguauguuaL96 | 2660 | sense | 21 |
| UAACAUACAUCCUAAAACAUUUG | 1565 | usAfsacaUfaCfAfuccuAfaAfacauuusug | 2661 | antis | 23 |
| AUCCAAAUGUUUUAGGAUGUA | 1566 | asusccaaAfuGfUfUfuuaggauguaL96 | 2662 | sense | 21 |
| UACAUCCUAAAACAUUUGGAUAU | 1567 | usAfscauCfcUfAfaaacAfuUfuggausasu | 2663 | antis | 23 |
| UAUCCAAAUGUUUUAGGAUGU | 1568 | usasuccaAfaUfGfUfuuuaggauguL96 | 2664 | sense | 21 |
| ACAUCCUAAAACAUUUGGAUAUA | 1569 | asCfsaucCfuAfAfaacaUfuUfggauasusa | 2665 | antis | 23 |
| AUGGGUGGCGGUAAUUGGUGA | 1570 | asusggguGfgCfGfGfuaauuggugaL96 | 2666 | sense | 21 |
| UCACCAAUUACCGCCACCCAUUC | 1571 | usCfsaccAfaUfUfaccgCfcAfcccaususc | 2667 | antis | 23 |
| UGGGUGGCGGUAAUUGGUGAU | 1572 | usgsgguGfcGfGfUfaauuggugauL96 | 2668 | sense | 21 |
| AUCACCAAUUACCGCCACCCAUU | 1573 | asUfscacCfaAfUfuaccGfcCfacccasusu | 2669 | antis | 23 |
| UGGAAUGGGUGGCGGUAAUUG | 1574 | usgsgaauGfgGfUfGfgcgguaauugL96 | 2670 | sense | 21 |
| CAAUUACCGCCACCCAUUCCAAU | 1575 | csAfsauuAfcCfGfccacCfcAfuuccasasu | 2671 | antis | 23 |
| UUGGAAUGGGUGGCGGUAAUU | 1576 | ususggaaUfgGfGfUfggcgguaauuL96 | 2672 | sense | 21 |
| AAUUACCGCCACCCAUUCCAAUU | 1577 | asAfsuuaCfcGfCfcaccCfaUfuccaasusu | 2673 | antis | 23 |
| UUCAAAGUGUUGGUAAUGCCU | 1578 | ususcaaaGfuGfUfUfgguaaugccuL96 | 2674 | sense | 21 |
| AGGCAUUACCAACACUUUGAACC | 1579 | asGfsgcaUfuAfCfcaacAfcUfuugaascsc | 2675 | antis | 23 |
| UCAAAGUGUUGGUAAUGCCUG | 1580 | uscsaaagUfgUfUfGfguaaugccugL96 | 2676 | sense | 21 |
| CAGGCAUUACCAACACUUUGAAC | 1581 | csAfsggcAfuUfAfccaaCfaCfuuugasasc | 2677 | antis | 23 |
| CAGGUUCAAAGUGUUGGUAAU | 1582 | csasgguuCfaAfAfGfuguugguaauL96 | 2678 | sense | 21 |
| AUUACCAACACUUUGAACCUGAG | 1583 | asUfsuacCfaAfCfacuuUfgAfaccugsasg | 2679 | antis | 23 |
| UCAGGUUCAAAGUGUUGGUAA | 1584 | uscsagguUfcAfAfAfguguuggu aaL96 | 2680 | sense | 21 |
| UUACCAACACUUUGAACCUGAGC | 1585 | usUfsaccAfaCfAfcuuuGfaAfccugasgsc | 2681 | antis | 23 |
| CCACCUCCUCAAUUGAAGAAG | 1586 | cscsaccuCfcUfCfAfauugaagaagL96 | 2682 | sense | 21 |
| CUUCUUCAAUUGAGGAGGUGGCC | 1587 | csUfsucuUfcAfAfuugaGfgAfgguggscsc | 2683 | antis | 23 |
| CACCUCCUCAAUUGAAGAAGU | 1588 | csasccucCfuCfAfAfauugaagaaguL96 | 2684 | sense | 21 |
| ACUUCUUCAAUUGAGGAGGUGGC | 1589 | asCfsuucUfcAfAfauugAfgGfaggugsgsc | 2685 | antis | 23 |
| UGGGCCACCUCCUCAAUUGAA | 1590 | usgsggccAfcCfUfCfcucaauugaaL96 | 2686 | sense | 21 |
| UUCAAUUGAGGAGGUGGCCCAGG | 1591 | usUfscaaUfuGfAfggagGfuGfgcccasgsg | 2687 | antis | 23 |
| CUGGGCCACCUCCUCAAUUGA | 1592 | csusgggcCfaCfCfUfccucaauugaL96 | 2688 | sense | 21 |
| UCAAUUGAGGAGGUGGCCCAGGA | 1593 | usCfsaauUfgAfGfgaggUfgGfcccagsgsa | 2689 | antis | 23 |
| GAGUGGGUGCCAGAAUGUGAA | 1594 | gsasguggGfuGfCfCfagaaugugaaL96 | 2690 | sense | 21 |
| UUCACAUUCUGGCACCCACUCAG | 1595 | usUfscacAfuUfCfuggcAfcCfcacucsasg | 2691 | antis | 23 |
| AGUGGGUGCCAGAAUGUGAAA | 1596 | asgsugggUfgCfCfAfgaaugugaaaL96 | 2692 | sense | 21 |
| UUUCACAUUCUGGCACCCACUCA | 1597 | usUfsucaCfaUfUfcuggCfaCfccacuscsa | 2693 | antis | 23 |

-continued

| Unmodified sequence | SEQ ID NO: | Modified sequence | SEQ ID NO: | strand | Length |
|---|---|---|---|---|---|
| CUCUGAGUGGGUGCCAGAAUG | 1598 | csuscugaGfuGfGfGfugccagaaugL96 | 2694 | sense | 21 |
| CAUUCUGGCACCCACUCAGAGCC | 1599 | csAfsuucUfgGfCfacccAfcUfcagagscsc | 2695 | antis | 23 |
| GCUCUGAGUGGGUGCCAGAAU | 1600 | gscsucugAfgUfGfGfgugccagaauL96 | 2696 | sense | 21 |
| AUUCUGGCACCCACUCAGAGCCA | 1601 | asUfsucuGfcCfAfcccaCfuCfagagcscsa | 2697 | antis | 23 |
| GCACUGAUGUUCUGAAAGCUC | 1602 | gscsacugAfuGfUfUfcugaaagcucL96 | 2698 | sense | 21 |
| GAGCUUUCAGAACAUCAGUGCCU | 1603 | gsAfsgcuUfuCfAfgaacAfuCfagugcscsu | 2699 | antis | 23 |
| CACUGAUGUUCUGAAAGCUCU | 1604 | csascugaUfgUfUfCfugaaagcucuL96 | 2700 | sense | 21 |
| AGAGCUUUCAGAACAUCAGUGCC | 1605 | asGfsagcUfuUfCfagaaCfaUfcagugscsc | 2701 | antis | 23 |
| AAAGGCACUGAUGUUCUGAAA | 1606 | asasaggcAfcUfGfAfuguucugaaaL96 | 2702 | sense | 21 |
| UUUCAGAACAUCAGUGCCUUUCC | 1607 | usUfsucaGfaAfCfaucaGfuGfccuuuscsc | 2703 | antis | 23 |
| GAAAGGCACUGAUGUUCUGAA | 1608 | gsasaaggCfaCfUfGfauguucugaaL96 | 2704 | sense | 21 |
| UUCAGAACAUCAGUGCCUUUCCG | 1609 | usUfscagAfaCfAfucagUfgCfcuuuscsg | 2705 | antis | 23 |
| GGGAAGGUGGAAGUCUUCCUG | 1610 | gsgsgaagGfuGfGfAfagucuuccugL96 | 2706 | sense | 21 |
| CAGGAAGACUUCCACCUUCCCUU | 1611 | csAfsggaAfgAfCfuuccAfcCfuucccsusu | 2707 | antis | 23 |
| GGAAGGUGGAAGUCUUCCUGG | 1612 | gsgsaaggUfgGfAfAfgucuuccuggL96 | 2708 | sense | 21 |
| CCAGGAAGACUUCCACCUUCCCU | 1613 | csCfsaggAfaGfAfcuucCfaCfcuuccscsu | 2709 | antis | 23 |
| GGAAGGGAAGGUGGAAGUCUU | 1614 | gsgsaaggGfaAfGfGfuggaagucuuL96 | 2710 | sense | 21 |
| AAGACUUCCACCUUCCCUUCCAC | 1615 | asAfsgacUfuCfCfaccuUfcCfcuuccsasc | 2711 | antis | 23 |
| UGGAAGGGAAGGUGGAAGUCU | 1616 | usgsgaagGfgAfAfGfguggaagucuL96 | 2712 | sense | 21 |
| AGACUUCCACCUUCCCUUCCACA | 1617 | asGfsacuUfcCfAfccuuCfcCfuuccascsa | 2713 | antis | 23 |
| UGCUAAAUCAGUACUUCCAAA | 1618 | usgscuaaAfuCfAfGfuacuuccaaaL96 | 2714 | sense | 21 |
| UUUGGAAGUACUGAUUUAGCAUG | 1619 | usUfsuggAfaGfUfacugAfuUfuagcsasug | 2715 | antis | 23 |
| GCUAAAUCAGUACUUCCAAAG | 1620 | gscsuaaaUfcAfGfUfacuuccaaagL96 | 2716 | sense | 21 |
| CUUUGGAAGUACUGAUUUAGCAU | 1621 | csUfsuugGfaAfGfuacuGfaUfuuagcsasu | 2717 | antis | 23 |
| AACAUGCUAAAUCAGUACUUC | 1622 | asascaugCfuAfAfAfucaguacuucL96 | 2718 | sense | 21 |
| GAAGUACUGAUUUAGCAUGUUGU | 1623 | gsAfsaguAfcUfGfauuuAfgCfauguusgsu | 2719 | antis | 23 |
| CAACAUGCUAAAUCAGUACUU | 1624 | csasacauGfcUfAfAfaucaguacuuL96 | 2720 | sense | 21 |
| AAGUACUGAUUUAGCAUGUUGUU | 1625 | asAfsguaCfuGfAfuuuaGfcAfuguugsusu | 2721 | antis | 23 |
| CCACAACUCAGGAUGAAAAAU | 1626 | cscsacaaCfuCfAfGfgaugaaaaauL96 | 2722 | sense | 21 |
| AUUUUUCAUCCUGAGUUGUGGCG | 1627 | asUfsuuuUfcAfUfccugAfgUfuguggscsg | 2723 | antis | 23 |
| CACAACUCAGGAUGAAAAAUU | 1628 | csascaacUfcAfGfGfaugaaaaauuL96 | 2724 | sense | 21 |
| AAUUUUUCAUCCUGAGUUGUGGC | 1629 | asAfsuuuUfuCfAfuccuGfaGfuugugsgsc | 2725 | antis | 23 |
| GCCGCCACAACUCAGGAUGAA | 1630 | gscscgccAfcAfAfCfucaggaugaaL96 | 2726 | sense | 21 |
| UUCAUCCUGAGUUGUGGCGGCAG | 1631 | usUfscauCfcUfGfaguuGfuGfgcggcsasg | 2727 | antis | 23 |
| UGCCGCCACAACUCAGGAUGA | 1632 | usgsccgcCfaCfAfAfcucaggaugaL96 | 2728 | sense | 21 |
| UCAUCCUGAGUUGUGGCGGCAGU | 1633 | usCfsaucCfuGfAfguugUfgGfgcggcsasgsu | 2729 | antis | 23 |
| GCAACCGUCUGGAUGAUGUGC | 1634 | gscsaaccGfuCfUfGfgaugaugugcL96 | 2730 | sense | 21 |
| GCACAUCAUCCAGACGGUUGCCC | 1635 | gsCfsacaUfcAfUfccagAfcGfguugcscsc | 2731 | antis | 23 |

-continued

| Unmodified sequence | SEQ ID NO: | Modified sequence | SEQ ID NO: | strand | Length |
|---|---|---|---|---|---|
| CAACCGUCUGGAUGAUGUGCG | 1636 | csasaccgUfcUfGfGfaugaugugcgL96 | 2732 | sense | 21 |
| CGCACAUCAUCCAGACGGUUGCC | 1637 | csGfscacAfuCfAfuccaGfaCfgguugcsc | 2733 | antis | 23 |
| CUGGGCAACCGUCUGGAUGAU | 1638 | csusgggCfaAfCfCfGfucuggaugauL96 | 2734 | sense | 21 |
| AUCAUCCAGACGGUUGCCCAGGU | 1639 | asUfscauCfcAfGfacggUfuGfcccagsgsu | 2735 | antis | 23 |
| CCUGGGCAACCGUCUGGAUGA | 1640 | cscsugggCfaAfCfCfgucuggaugaL96 | 2736 | sense | 21 |
| UCAUCCAGACGGUUGCCCAGGUA | 1641 | usCfsaucCfaGfAfcgguUfgCfccaggsusa | 2737 | antis | 23 |
| GCAAAUGAUGAAGAAACUUUG | 1642 | gscsaaauGfaUfGfAfagaaacuuugL96 | 2738 | sense | 21 |
| CAAAGUUUCUUCAUCAUUUGCCC | 1643 | csAfsaagUfuUfCfuucaUfcAfuuugcscsc | 2739 | antis | 23 |
| CAAAUGAUGAAGAAACUUUGG | 1644 | csasaaugAfuGfAfAfgaaacuuugGL96 | 2740 | sense | 21 |
| CCAAAGUUUCUUCAUCAUUUGCC | 1645 | csCfsaaaGfuUfUfcuucAfuCfauuugcscsc | 2741 | antis | 23 |
| UGGGGCAAAUGAUGAAGAAAC | 1646 | usgsgggCfaAfAfUfGfaugaagaaacL96 | 2742 | sense | 21 |
| GUUUCUUCAUCAUUUGCCCCAGA | 1647 | gsUfsuucUfuCfAfucauUfuGfcccscasgsa | 2743 | antis | 23 |
| CUGGGGCAAAUGAUGAAGAAA | 1648 | csusggggCfaAfAfUfgaugaagaaaL96 | 2744 | sense | 21 |
| UUUCUUCAUCAUUUGCCCCAGAC | 1649 | usUfsucuUfcAfUfcauuUfgCfcccagsasc | 2745 | antis | 23 |
| CCAAGGCUGUGUUUGUGGGGA | 1650 | cscsaaggCfuGfUfGfuuugugggaL96 | 2746 | sense | 21 |
| UCCCCACAAACACAGCCUUGGCG | 1651 | usCfscccAfcAfAfacacAfgCfcuuggscsg | 2747 | antis | 23 |
| CAAGGCUGUGUUUGUGGGGAG | 1652 | csasaggcUfgUfGfUfuuugggggagL96 | 2748 | sense | 21 |
| CUCCCCACAAACACAGCCUUGGC | 1653 | csUfscccCfaCfAfaacaCfaGfccuugsgsc | 2749 | antis | 23 |
| GGCGCCAAGGCUGUGUUUGUG | 1654 | gsgscgccAfaGfGfCfuguguuugugL96 | 2750 | sense | 21 |
| CACAAACACAGCCUUGGCGCCAA | 1655 | csAfscaaAfcAfCfagccUfuGfgcgccsasa | 2751 | antis | 23 |
| UGGCGCCAAGGCUGUGUUUGU | 1656 | usgsgcgcCfaAfGfGfcuguguuuguL96 | 2752 | sense | 21 |
| ACAAACACAGCCUUGGCGCCAAG | 1657 | asCfsaaaCfaCfAfgccuUfgGfcgccasasg | 2753 | antis | 23 |
| ACUGCCGCCACAACUCAGGAU | 1658 | ascsugccGfcCfAfCfaacucaggauL96 | 2754 | sense | 21 |
| AUCCUGAGUUGUGGCGGCAGUUU | 1659 | asUfsccuGfaGfUfugugGfcGfgcagususu | 2755 | antis | 23 |
| CUGCCGCCACAACUCAGGAUG | 1660 | csusgccgCfcAfCfAfacucaggaugL96 | 2756 | sense | 21 |
| CAUCCUGAGUUGUGGCGGCAGUU | 1661 | csAfsuccUfgAfGfuuguGfcGfggcagsusu | 2757 | antis | 23 |
| UCAAACUGCCGCCACAACUCA | 1662 | uscsaaacUfgCfCfGfccacaacucaL96 | 2758 | sense | 21 |
| UGAGUUGUGGCGGCAGUUUGAAU | 1663 | usGfsaguUfgUfGfgcggCfaGfuuugasasu | 2759 | antis | 23 |
| UUCAAACUGCCGCCACAACUC | 1664 | ususcaaaCfuGfCfCfgccacaacucL96 | 2760 | sense | 21 |
| GAGUUGUGGCGGCAGUUUGAAUC | 1665 | gsAfsguuGfuGfGfcggcAfgUfuugaasusc | 2761 | antis | 23 |
| GGGAAGAUAUCAAAUGGCUGA | 1666 | gsgsgaagAfuAfUfCfaaauggcugaL96 | 2762 | sense | 21 |
| UCAGCCAUUUGAUAUCUUCCCAG | 1667 | usCfsagcCfaUfUfugauAfuCfuucccsasg | 2763 | antis | 23 |
| GGAAGAUAUCAAAUGGCUGAG | 1668 | gsgsaagaUfaUfCfAfaauggcugagL96 | 2764 | sense | 21 |
| CUCAGCCAUUUGAUAUCUUCCCA | 1669 | csUfscagCfcAfUfuugaUfaUfcuuccscsa | 2765 | antis | 23 |
| AGCUGGGAAGAUAUCAAAUGG | 1670 | asgscuggGfaAfGfAfuaucaaauggL96 | 2766 | sense | 21 |
| CCAUUUGAUAUCUUCCCAGCUGA | 1671 | csCfsauuUfgAfUfaucuUfcCfcagcusgsa | 2767 | antis | 23 |
| CAGCUGGGAAGAUAUCAAAUG | 1672 | csasgcugGfgAfAfGfauaucaaaugL96 | 2768 | sense | 21 |
| CAUUUGAUAUCUUCCCAGCUGAU | 1673 | csAfsuuuGfaUfAfucuuCfcCfagcugsasu | 2769 | antis | 23 |

| Unmodified sequence | SEQ ID NO: | Modified sequence | SEQ ID NO: | strand | Length |
|---|---|---|---|---|---|
| AAUCAGUACUUCCAAAGUCUA | 1674 | asasucagUfaCfUfUfccaaagucuaL96 | 2770 | sense | 21 |
| UAGACUUUGGAAGUACUGAUUUA | 1675 | usAfsgacUfuUfGfgaagUfaCfugauususa | 2771 | antis | 23 |
| AUCAGUACUUCCAAAGUCUAU | 1676 | asuscaguAfcUfUfCfcaaagucuauL96 | 2772 | sense | 21 |
| AUAGACUUUGGAAGUACUGAUUU | 1677 | asUfsagaCfuUfUfggaaGfuAfcugaususu | 2773 | antis | 23 |
| GCUAAAUCAGUACUUCCAAAG | 1678 | gscsuaaaUfcAfGfUfacuuccaaagL96 | 2774 | sense | 21 |
| CUUUGGAAGUACUGAUUUAGCAU | 1679 | csUfsuugGfaAfGfuacuGfaUfuuagcsasu | 2775 | antis | 23 |
| UGCUAAAUCAGUACUUCCAAA | 1680 | usgscuaaAfuCfAfGfuacuuccaaaL96 | 2776 | sense | 21 |
| UUUGGAAGUACUGAUUUAGCAUG | 1681 | usUfsuggAfaGfUfacugAfuUfuagcasusg | 2777 | antis | 23 |
| UCAGCAUGCCAAUAUGUGUGG | 1682 | uscsagcaUfgCfCfAfauaugugugGL96 | 2778 | sense | 21 |
| CCACACAUAUUGGCAUGCUGACC | 1683 | csCfsacaCfaUfAfuuggCfaUfgcugascsc | 2779 | antis | 23 |
| CAGCAUGCCAAUAUGUGUGGG | 1684 | csasgcauGfcCfAfAfuaugugugggL96 | 2780 | sense | 21 |
| CCCACACAUAUUGGCAUGCUGAC | 1685 | csCfscacAfcAfUfauugGfcAfugcugsasc | 2781 | antis | 23 |
| AGGGUCAGCAUGCCAAUAUGU | 1686 | asgsgguCfagCfAfUfgccaauauguL96 | 2782 | sense | 21 |
| ACAUAUUGGCAUGCUGACCCUCU | 1687 | asCfsauaUfuGfGfcaugCfuGfacccuscsu | 2783 | antis | 23 |
| GAGGGUCAGCAUGCCAAUAUG | 1688 | gsasggguCfaGfCfAfugccaauaugL96 | 2784 | sense | 21 |
| CAUAUUGGCAUGCUGACCCUCUG | 1689 | csAfsuauUfgGfCfaugcUfgAfcccucsusg | 2785 | antis | 23 |
| GCAUAUGUGGCUAAAGCAAUA | 1690 | gscsauauGfuGfGfCfuaaagcaauaL96 | 2786 | sense | 21 |
| UAUUGCUUUAGCCACAUAUGCAG | 1691 | usAfsuugCfuUfUfagccAfcAfuaugcsasg | 2787 | antis | 23 |
| CAUAUGUGGCUAAAGCAAUAG | 1692 | csasuaugUfgGfCfUfaaagcaauagL96 | 2788 | sense | 21 |
| CUAUUGCUUUAGCCACAUAUGCA | 1693 | csUfsauuGfcUfUfuagcCfaCfauaugscsa | 2789 | antis | 23 |
| UGCUGCAUAUGUGGCUAAAGC | 1694 | usgscugcAfuAfUfGfuggcuaaagcL96 | 2790 | sense | 21 |
| GCUUUAGCCACAUAUGCAGCAAG | 1695 | gsCfsuuuAfgCfCfacauAfuGfcagcasasg | 2791 | antis | 23 |
| UUGCUGCAUAUGUGGCUAAAG | 1696 | ususgcugCfaUfAfUfguggcuaaagL96 | 2792 | sense | 21 |
| CUUUAGCCACAUAUGCAGCAAGU | 1697 | csUfsuuaGfcCfAfcauaUfgCfagcaasgsu | 2793 | antis | 23 |
| AAAUGAUGAAGAAACUUUGGC | 1698 | asasaugaUfgAfAfGfaaacuuuggcL96 | 2794 | sense | 21 |
| GCCAAAGUUUCUUCAUCAUUUGC | 1699 | gsCfscaaAfgUfUfucuuCfaUfcauuusgsc | 2795 | antis | 23 |
| AAUGAUGAAGAAACUUUGGCU | 1700 | asasugauGfaAfGfAfaacuuuggcuL96 | 2796 | sense | 21 |
| AGCCAAAGUUUCUUCAUCAUUUG | 1701 | asGfsccaAfaGfUfuucuUfcAfucauususg | 2797 | antis | 23 |
| GGGCAAAUGAUGAAGAAACUU | 1702 | gsgsgcaaAfuGfAfUfgaagaaacuuL96 | 2798 | sense | 21 |
| AAGUUUCUUCAUCAUUUGCCCCA | 1703 | asAfsguuUfcUfUfcaucAfuUfugcccscsa | 2799 | antis | 23 |
| GGGGCAAAUGAUGAAGAAACU | 1704 | gsgsggcaAfaUfGfAfugaagaaacuL96 | 2800 | sense | 21 |
| AGUUUCUUCAUCAUUUGCCCCAG | 1705 | asGfsuuuCfuUfCfaucaUfuUfgccccsasg | 2801 | antis | 23 |
| GAGAUACUAAAGGAAGAAUUC | 1706 | gsasgauaCfuAfAfAfggaagaauucL96 | 2802 | sense | 21 |
| GAAUUCUUCCUUUAGUAUCUCGA | 1707 | gsAfsauuCfuUfCfcuuuAfgUfaucucsgsa | 2803 | antis | 23 |
| AGAUACUAAAGGAAGAAUUCC | 1708 | asgsauacUfaAfAfGfgaagaauuccL96 | 2804 | sense | 21 |
| GGAAUUCUUCCUUUAGUAUCUCG | 1709 | gsGfsaauUfcUfUfccuuUfaGfuaucuscsg | 2805 | antis | 23 |
| CCUCGAGAUACUAAAGGAAGA | 1710 | cscsucgaGfaUfAfCfuaaaggaagaL96 | 2806 | sense | 21 |
| UCUUCCUUUAGUAUCUCGAGGAC | 1711 | usCfsuucCfuUfUfaguaUfcUfcgaggsasc | 2807 | antis | 23 |

-continued

| Unmodified sequence | SEQ ID NO: | Modified sequence | SEQ ID NO: | strand | Length |
|---|---|---|---|---|---|
| UCCUCGAGAUACUAAAGGAAG | 1712 | uscscucgAfgAfUfAfcuaaaggaagL96 | 2808 | sense | 21 |
| CUUCCUUUAGUAUCUCGAGGACA | 1713 | csUfsuccUfuUfAfguauCfuCfgaggascsa | 2809 | antis | 23 |
| ACAACUCAGGAUGAAAAAUUU | 1714 | ascsaacuCfaGfGfAfugaaaaauuuL96 | 2810 | sense | 21 |
| AAAUUUUUCAUCCUGAGUUGUGG | 1715 | asAfsauuUfUfUfCfauccUfgAfguugusgsg | 2811 | antis | 23 |
| CAACUCAGGAUGAAAAAUUUU | 1716 | csasacucAfgGfAfUfgaaaaauuuuL96 | 2812 | sense | 21 |
| AAAAUUUUUCAUCCUGAGUUGUG | 1717 | asAfsaauUfUfUfUfcaucCfuGfaguugsusg | 2813 | antis | 23 |
| CGCCACAACUCAGGAUGAAAA | 1718 | csgsccacAfaCfUfCfaggaugaaaaL96 | 2814 | sense | 21 |
| UUUUCAUCCUGAGUUGUGGCGGC | 1719 | usUfsuucAfuCfCfugagUfuGfuggcgsgsc | 2815 | antis | 23 |
| CCGCCACAACUCAGGAUGAAA | 1720 | cscsgccaCfaAfCfUfcaggaugaaaL96 | 2816 | sense | 21 |
| UUUCAUCCUGAGUUGUGGCGGCA | 1721 | usUfsucaUfcCfUfgaguUfgUfggcggscsa | 2817 | antis | 23 |
| AGGGAAGGUGGAAGUCUUCCU | 1722 | asgsggaaGfgUfGfGfaagucuuccuL96 | 2818 | sense | 21 |
| AGGAAGACUUCCACCUUCCCUUC | 1723 | asGfsgaaGfaCfUfuccaCfcUfucccususc | 2819 | antis | 23 |
| GGGAAGGUGGAAGUCUUCCUG | 1724 | gsgsgaagGfuGfGfAfagucuuccugL96 | 2820 | sense | 21 |
| CAGGAAGACUUCCACCUUCCCUU | 1725 | csAfsggaAfgAfCfuuccAfcCfuucccsusu | 2821 | antis | 23 |
| UGGAAGGGAAGGUGGAAGUCU | 1726 | usgsgaagGfgAfAfGfguggaagucuL96 | 2822 | sense | 21 |
| AGACUUCCACCUUCCCUUCCACA | 1727 | asGfsacuUfcCfAfccuuCfcCfuuccascsa | 2823 | antis | 23 |
| GUGGAAGGGAAGGUGGAAGUC | 1728 | gsusggaaGfgGfAfAfgguggaagucL96 | 2824 | sense | 21 |
| GACUUCCACCUUCCCUUCCACAG | 1729 | gsAfscuuCfcAfCfcuucCfcUfuccacsasg | 2825 | antis | 23 |
| GGCGAGCUUGCCACUGUGAGA | 1730 | gsgscgagCfuUfGfCfcacugugagaL96 | 2826 | sense | 21 |
| UCUCACAGUGGCAAGCUCGCCGU | 1731 | usCfsucaCfaGfUfggcaAfgCfucgccsgsu | 2827 | antis | 23 |
| GCGAGCUUGCCACUGUGAGAG | 1732 | gscsgagcUfuGfCfCfacugugagagL96 | 2828 | sense | 21 |
| CUCUCACAGUGGCAAGCUCGCCG | 1733 | csUfscucAfcAfGfuggcAfaGfcucgcscsg | 2829 | antis | 23 |
| GGACGGCGAGCUUGCCACUGU | 1734 | gsgsacggCfgAfGfCfuugccacuguL96 | 2830 | sense | 21 |
| ACAGUGGCAAGCUCGCCGUCCAC | 1735 | asCfsaguGfgCfAfagcuCfgCfguccsasc | 2831 | antis | 23 |
| UGGACGGCGAGCUUGCCACUG | 1736 | usgsgacgGfcGfAfGfcuugccacugL96 | 2832 | sense | 21 |
| CAGUGGCAAGCUCGCCGUCCACA | 1737 | csAfsgugGfcAfAfgcucGfcCfguccascsa | 2833 | antis | 23 |
| AUGUGCGUAACAGAUUCAAAC | 1738 | asusgugcGfuAfAfCfagauucaaacL96 | 2834 | sense | 21 |
| GUUUGAAUCUGUUACGCACAUCA | 1739 | gsUfsuugAfaUfCfuguuAfcGfcacauscsa | 2835 | antis | 23 |
| UGUGCGUAACAGAUUCAAACU | 1740 | usgsugcgUfaAfCfAfgauucaaacuL96 | 2836 | sense | 21 |
| AGUUUGAAUCUGUUACGCACAUC | 1741 | asGfsuuuGfaAfUfcuguUfaCfgcacasusc | 2837 | antis | 23 |
| GAUGAUGUGCGUAACAGAUUC | 1742 | gsasugauGfuGfCfGfuaacagauucL96 | 2838 | sense | 21 |
| GAAUCUGUUACGCACAUCAUCCA | 1743 | gsAfsaucUfgUfUfacgcAfcAfucauscscsa | 2839 | antis | 23 |
| GGAUGAUGUGCGUAACAGAUU | 1744 | gsgsaugaUfgUfGfCfguaacagauuL96 | 2840 | sense | 21 |
| AAUCUGUUACGCACAUCAUCCAG | 1745 | asAfsucuGfuUfAfcgcaCfaUfcauccsasg | 2841 | antis | 23 |
| GGGUCAGCAUGCCAAUAUGUG | 1746 | gsgsgucaGfcAfUfGfccaauauguGL96 | 2842 | sense | 21 |
| CACAUAUUGGCAUGCUGACCCUC | 1747 | csAfscauAfuUfGfgcauGfcUfgacccsusc | 2843 | antis | 23 |
| GGUCAGCAUGCCAAUAUGUGU | 1748 | gsgsucagCfaUfGfCfcaauauguguL96 | 2844 | sense | 21 |
| ACACAUAUUGGCAUGCUGACCCU | 1749 | asCfsacaUfaUfUfggcaUfgCfugaccscsu | 2845 | antis | 23 |

| Unmodified sequence | SEQ ID NO: | Modified sequence | SEQ ID NO: | strand | Length |
|---|---|---|---|---|---|
| CAGAGGGUCAGCAUGCCAAUA | 1750 | csasgaggGfuCfAfGfcaugccaauaL96 | 2846 | sense | 21 |
| UAUUGGCAUGCUGACCCUCUGUC | 1751 | usAfsuugGfcAfUfgcugAfcCfcucugsusc | 2847 | antis | 23 |
| ACAGAGGGUCAGCAUGCCAAU | 1752 | ascsagagGfgUfCfAfgcaugccaauL96 | 2848 | sense | 21 |
| AUUGGCAUGCUGACCCUCUGCC | 1753 | asUfsuggCfaUfGfcugaCfcCfucuguscsc | 2849 | antis | 23 |
| GCUUGAAUGGGAUCUUGGUGU | 1754 | gscsuugaAfuGfGfGfaucuugguguL96 | 2850 | sense | 21 |
| ACACCAAGAUCCCAUUCAAGCCA | 1755 | asCfsaccAfaGfAfucccAfuUfcaagcscsa | 2851 | antis | 23 |
| CUUGAAUGGGAUCUUGGUGUC | 1756 | csusugaaUfgGfGfAfucuuggugucL96 | 2852 | sense | 21 |
| GACACCAAGAUCCCAUUCAAGCC | 1757 | gsAfscacCfaAfGfauccCfaUfucaagscsc | 2853 | antis | 23 |
| CAUGGCUUGAAUGGGAUCUUG | 1758 | csasuggcUfuGfAfAfugggaucuugL96 | 2854 | sense | 21 |
| CAAGAUCCCAUUCAAGCCAUGUU | 1759 | csAfsagaUfcCfCfauucAfaGfccaugsusu | 2855 | antis | 23 |
| ACAUGGCUUGAAUGGGAUCUU | 1760 | ascsauggCfuUfGfAfaugggaucuuL96 | 2856 | sense | 21 |
| AAGAUCCCAUUCAAGCCAUGUUU | 1761 | asAfsgauCfcCfAfuucaAfgCfcaugususu | 2857 | antis | 23 |
| UCAAAUGGCUGAGAAGACUGA | 1762 | uscsaaauGfgCfUfGfagaagacugaL96 | 2858 | sense | 21 |
| UCAGUCUUCUCAGCCAUUUGAUA | 1763 | usCfsaguCfuUfCfucagCfcAfuuugasusa | 2859 | antis | 23 |
| CAAAUGGCUGAGAAGACUGAC | 1764 | csasaaugGfcUfGfAfgaagacugacL96 | 2860 | sense | 21 |
| GUCAGUCUUCUCAGCCAUUUGAU | 1765 | gsUfscagUfcUfUfcucaGfcCfauuugsasu | 2861 | antis | 23 |
| GAUAUCAAAUGGCUGAGAAGA | 1766 | gsasuaucAfaAfUfGfgcugagaagaL96 | 2862 | sense | 21 |
| UCUUCUCAGCCAUUUGAUAUCUU | 1767 | usCfsuucUfcAfGfccauUfuGfauaucsusu | 2863 | antis | 23 |
| AGAUAUCAAAUGGCUGAGAAG | 1768 | asgsauauCfaAfAfUfggcugagaagL96 | 2864 | sense | 21 |
| CUUCUCAGCCAUUUGAUAUCUUC | 1769 | csUfsucuCfaGfCfcauuUfgAfuaucsusc | 2865 | antis | 23 |
| GAAAGUCAUCGACAAGACAUU | 1770 | gsasaaguCfaUfCfGfacaagacauuL96 | 2866 | sense | 21 |
| AAUGUCUUGUCGAUGACUUUCAC | 1771 | asAfsuguCfuUfGfucgaUfgAfcuuucsasc | 2867 | antis | 23 |
| AAAGUCAUCGACAAGACAUUG | 1772 | asasagucAfuCfGfAfcaagacauugL96 | 2868 | sense | 21 |
| CAAUGUCUUGUCGAUGACUUUCA | 1773 | csAfsaugUfcUfUfgucgAfuGfacuuuscsa | 2869 | antis | 23 |
| AUGUGAAAGUCAUCGACAAGA | 1774 | asusgugaAfaGfUfCfaucgacaagaL96 | 2870 | sense | 21 |
| UCUUGUCGAUGACUUUCACAUUC | 1775 | usCfsuugUfcGfAfugacUfuUfcacaususc | 2871 | antis | 23 |
| AAUGUGAAAGUCAUCGACAAG | 1776 | asasagugAfaAfGfUfcaucgacaagL96 | 2872 | sense | 21 |
| CUUGUCGAUGACUUUCACAUUCU | 1777 | csUfsuguCfgAfUfgacuUfcAfcauuscsu | 2873 | antis | 23 |
| GGCUAAUUUGUAUCAAUGAUU | 1778 | gsgscuaaUfuUfGfUfaucaaugauuL96 | 2874 | sense | 21 |
| AAUCAUUGAUACAAAUUAGCCGG | 1779 | asAfsucaUfuGfAfuacaAfaUfuagccsgsg | 2875 | antis | 23 |
| GCUAAUUUGUAUCAAUGAUUA | 1780 | gscsuaauUfuGfUfAfucaaugauuaL96 | 2876 | sense | 21 |
| UAAUCAUUGAUACAAAUUAGCCG | 1781 | usAfsaucAfuUfGfauacAfaAfuuagcscsg | 2877 | antis | 23 |
| CCCCGGCUAAUUUGUAUCAAU | 1782 | cscsccggCfuAfAfUfuuguaucaauL96 | 2878 | sense | 21 |
| AUUGAUACAAAUUAGCCGGGGA | 1783 | asUfsugaUfaCfAfaauuAfgCfcggggsgsa | 2879 | antis | 23 |
| CCCCCGGCUAAUUUGUAUCAA | 1784 | cscscccgGfcUfAfAfuuuguaucaaL96 | 2880 | sense | 21 |
| UUGAUACAAAUUAGCCGGGGGAG | 1785 | usUfsgauAfcAfAfauuaGfcCfgggggsasg | 2881 | antis | 23 |
| UGUCGACUUCUGUUUUAGGAC | 1786 | usgsucgaCfuUfCfUfguuuuaggacL96 | 2882 | sense | 21 |
| GUCCUAAAACAGAAGUCGACAGA | 1787 | gsUfsccuAfaAfAfcagaAfgUfcgacasgsa | 2883 | antis | 23 |

-continued

| Unmodified sequence | SEQ ID NO: | Modified sequence | SEQ ID NO: | strand | Length |
|---|---|---|---|---|---|
| GUCGACUUCUGUUUAGGACA | 1788 | gsuscgacUfuCfUfGfuuuuaggacaL96 | 2884 | sense | 21 |
| UGUCCUAAAACAGAAGUCGACAG | 1789 | usGfsuccUfaAfAfacagAfaGfucgacsasg | 2885 | antis | 23 |
| GAUCUGUCGACUUCUGUUUUA | 1790 | gsasucugUfcGfAfCfuucuguuuuaL96 | 2886 | sense | 21 |
| UAAAACAGAAGUCGACAGAUCUG | 1791 | usAfsaaaCfaGfAfagucGfaCfagaucsusg | 2887 | antis | 23 |
| AGAUCUGUCGACUUCUGUUUU | 1792 | asgsaucuGfuCfGfAfcuucuguuuuL96 | 2888 | sense | 21 |
| AAAACAGAAGUCGACAGAUCGU | 1793 | asAfsaacAfgAfAfgucgAfcAfgaucusgu | 2889 | antis | 23 |
| CCGAGAAGUCACCAAGAAGCU | 1794 | cscsgagaAfgUfCfAfccaagaagcuL96 | 2890 | sense | 21 |
| AGCUUCUUGGUGACUUCUCGGUC | 1795 | asGfscuuCfuUfGfgugaCfuUfcucggsusc | 2891 | antis | 23 |
| CGAGAAGUCACCAAGAAGCUA | 1796 | csgsagaaGfuCfAfCfcaagaagcuaL96 | 2892 | sense | 21 |
| UAGCUUCUUGGUGACUUCUCGGU | 1797 | usAfsgcuUfcUfUfggugAfcUfucucgsgsu | 2893 | antis | 23 |
| AGGACCGAGAAGUCACCAAGA | 1798 | asgsgaccGfaGfAfAfgucaccaagaL96 | 2894 | sense | 21 |
| UCUUGGUGACUUCUCGGUCCUUG | 1799 | usCfsuugGfuGfAfcuucUfcGfguccususg | 2895 | antis | 23 |
| AAGGACCGAGAAGUCACCAAG | 1800 | asasggacCfgAfGfAfagucaccaagL96 | 2896 | sense | 21 |
| CUUGGUGACUUCUCGGUCCUUGU | 1801 | csUfsuggUfgAfCfuucuCfgGfuccuusgsu | 2897 | antis | 23 |
| AAACAUGGCUUGAAUGGGAUC | 1802 | asasacauGfgCfUfUfgaaugggaucL96 | 2898 | sense | 21 |
| GAUCCCAUUCAAGCCAUGUUUAA | 1803 | gsAfsuccCfaUfUfcaagCfcAfuguuusasa | 2899 | antis | 23 |
| AACAUGGCUUGAAUGGGAUCU | 1804 | asascaugGfcUfUfGfaaugggaucuL96 | 2900 | sense | 21 |
| AGAUCCCAUUCAAGCCAUGUUUA | 1805 | asGfsaucCfcAfUfucaaGfcCfauguususa | 2901 | antis | 23 |
| UGUUAAACAUGGCUUGAAUGG | 1806 | usgsuuaaAfcAfUfGfgcuugaauggL96 | 2902 | sense | 21 |
| CCAUUCAAGCCAUGUUUAACAGC | 1807 | csCfsauuCfaAfGfccauGfuUfuaacasgsc | 2903 | antis | 23 |
| CUGUUAAACAUGGCUUGAAUG | 1808 | csusguuaAfaCfAfUfggcuugaaugL96 | 2904 | sense | 21 |
| CAUUCAAGCCAUGUUUAACAGCC | 1809 | csAfsuucAfaGfCfcaugUfuUfaacagscsc | 2905 | antis | 23 |
| GACUUGCUGCAUAUGUGGCUA | 1810 | gsascuugCfuGfCfAfuaugugggcuaL96 | 2906 | sense | 21 |
| UAGCCACAUAUGCAGCAAGUCCA | 1811 | usAfsgccAfcAfUfaugcAfgCfaagucscsa | 2907 | antis | 23 |
| ACUUGCUGCAUAUGUGGCUAA | 1812 | ascsuugcUfgCfAfUfaugugggcuaaL96 | 2908 | sense | 21 |
| UUAGCCACAUAUGCAGCAAGUCC | 1813 | usUfsagcCfaCfAfuaugCfaGfcaaguscsc | 2909 | antis | 23 |
| AGUGGACUUGCUGCAUAUGUG | 1814 | asgsuggaCfuUfGfCfugcauaugugL96 | 2910 | sense | 21 |
| CACAUAUGCAGCAAGUCCACUGU | 1815 | csAfscauAfuGfCfagcaAfgUfccacusgsu | 2911 | antis | 23 |
| CAGUGGACUUGCUGCAUAUGU | 1816 | csasguggAfcUfUfGfcugcauauguL96 | 2912 | sense | 21 |
| ACAUAUGCAGCAAGUCCACUGUC | 1817 | asCfsauaUfgCfAfgcaaGfuCfcacugsusc | 2913 | antis | 23 |
| UAAAUCAGUACUUCCAAAGUC | 1818 | usasaaucAfgUfAfCfuuccaaagucL96 | 2914 | sense | 21 |
| GACUUUGGAAGUACUGAUUUAGC | 1819 | gsAfscuuUfgGfAfaguaCfuGfauuuasgsc | 2915 | antis | 23 |
| AAAUCAGUACUUCCAAAGUCU | 1820 | asasaucaGfuAfCfUfuccaaagucuL96 | 2916 | sense | 21 |
| AGACUUUGGAAGUACUGAUUUAG | 1821 | asGfsacuUfgGfAfaguAfcUfgauuusasg | 2917 | antis | 23 |
| AUGCUAAAUCAGUACUUCCAA | 1822 | asusgcuaAfaUfCfAfguacuuccaaL96 | 2918 | sense | 21 |
| UUGGAAGUACUGAUUUAGCAUGU | 1823 | usUfsggaAfgUfAfcugaUfuUfagcausgsu | 2919 | antis | 23 |
| CAUGCUAAAUCAGUACUUCCA | 1824 | csasugcuAfaAfUfCfaguacuuccaL96 | 2920 | sense | 21 |
| UGGAAGUACUGAUUUAGCAUGUU | 1825 | usGfsgaaGfuAfCfugauUfuAfgcaugsusu | 2921 | antis | 23 |

-continued

| Unmodified sequence | SEQ ID NO: | Modified sequence | SEQ ID NO: | strand | Length |
|---|---|---|---|---|---|
| UCCUCAAUUGAAGAAGUGGCG | 1826 | uscscucaAfuUfGfAfagaaguggcgL96 | 2922 | sense | 21 |
| CGCCACUUCUUCAAUUGAGGAGG | 1827 | csGfsccaCfuUfCfuucaAfuUfgaggasgsg | 2923 | antis | 23 |
| CCUCAAUUGAAGAAGUGGCGG | 1828 | cscsucaaUfuGfAfAfgaaguggcggL96 | 2924 | sense | 21 |
| CCGCCACUUCUUCAAUUGAGGAG | 1829 | csCfsgccAfcUfUfcuucAfaUfugaggsasg | 2925 | antis | 23 |
| CACCUCCUCAAUUGAAGAAGU | 1830 | csasccucCfuCfAfAfuugaagaaguL96 | 2926 | sense | 21 |
| ACUUCUUCAAUUGAGGAGGUGGC | 1831 | asCfsuucUfuCfAfauugAfgGfaggugsgsc | 2927 | antis | 23 |
| CCACCUCCUCAAUUGAAGAAG | 1832 | cscsaccuCfcUfCfAfauugaagaagL96 | 2928 | sense | 21 |
| CUUCUUCAAUUGAGGAGGUGGCC | 1833 | csUfsucuUfcAfAfuugaGfgAfgguggscsc | 2929 | antis | 23 |
| CAAGAUGUCCUCGAGAUACUA | 1834 | csasagauGfuCfCfUfcgagauacuaL96 | 2930 | sense | 21 |
| UAGUAUCUCGAGGACAUCUUGAA | 1835 | usAfsguaUfcUfCfgaggAfcAfucuugsasa | 2931 | antis | 23 |
| AAGAUGUCCUCGAGAUACUAA | 1836 | asasgaugUfcCfUfCfgagauacuaaL96 | 2932 | sense | 21 |
| UUAGUAUCUCGAGGACAUCUUGA | 1837 | usUfsaguAfuCfUfCfcgagGfaCfaucuusgsa | 2933 | antis | 23 |
| UGUUCAAGAUGUCCUCGAGAU | 1838 | usgsuucaAfgAfUfGfuccucgagauL96 | 2934 | sense | 21 |
| AUCUCGAGGACAUCUUGAACACC | 1839 | asUfscucGfaGfGfacauCfuUfgaacascsc | 2935 | antis | 23 |
| GUGUUCAAGAUGUCCUCGAGA | 1840 | gsusguucAfaGfAfUfguccucgagaL96 | 2936 | sense | 21 |
| UCUCGAGGACAUCUUGAACACCU | 1841 | usCfsucgAfgGfAfcaucUfuGfaacacscsu | 2937 | antis | 23 |
| ACAUGCUAAAUCAGUACUUCC | 1842 | ascsaugcUfaAfAfUfcaguacuuccL96 | 2938 | sense | 21 |
| GGAAGUACUGAUUUAGCAUGUUG | 1843 | gsGfsaagUfaCfUfgauuUfaGfcaugususg | 2939 | antis | 23 |
| CAUGCUAAAUCAGUACUUCCA | 1844 | csasugcUfaAfAfUfCfaguacuuccaL96 | 2940 | sense | 21 |
| UGGAAGUACUGAUUUAGCAUGUU | 1845 | usGfsgaaGfuAfCfugauUfuAfgcaugsusu | 2941 | antis | 23 |
| AACAACAUGCUAAAUCAGUAC | 1846 | asascaacAfuGfCfUfaaaucaguacL96 | 2942 | sense | 21 |
| GUACUGAUUUAGCAUGUUGUUCA | 1847 | gsUfsacuGfaUfUfuagcAfuGfuuguuscsa | 2943 | antis | 23 |
| GAACAACAUGCUAAAUCAGUA | 1848 | gsasacaaCfaUfGfCfuaaaucaguaL96 | 2944 | sense | 21 |
| UACUGAUUUAGCAUGUUGUUCAU | 1849 | usAfscugAfuUfUfagcaUfgUfuguucsasu | 2945 | antis | 23 |
| GAAAGGCACUGAUGUUCUGAA | 1850 | gsasaaggCfaCfUfGffauguucugaaL96 | 2946 | sense | 21 |
| UUCAGAACAUCAGUGCCUUUCCG | 1851 | usUfscagAfaCfAfucagUfgCfcuuucscsg | 2947 | antis | 23 |
| AAAGGCACUGAUGUUCUGAAA | 1852 | asasaggcAfcUfGfAfuguucugaaaL96 | 2948 | sense | 21 |
| UUUCAGAACAUCAGUGCCUUUCC | 1853 | usUfsucaGfaAfCfaucaGfuGfccuuuscsc | 2949 | antis | 23 |
| UGCGGAAAGGCACUGAUGUUC | 1854 | usgscggaAfaGfGfCfacugauguucL96 | 2950 | sense | 21 |
| GAACAUCAGUGCCUUUCCGCACA | 1855 | gsAfsacaUfcAfGfugccUfuUfccgcascsa | 2951 | antis | 23 |
| GUGCGGAAAGGCACUGAUGUU | 1856 | gsusgcggAfaAfGfGfcacugauguuL96 | 2952 | sense | 21 |
| AACAUCAGUGCCUUUCCGCACAC | 1857 | asAfscauCfaGfUfgccuUfuCfcgcacsasc | 2953 | antis | 23 |
| GUCAGCAUGCCAAUAUGUGUG | 1858 | gsuscagcAfuGfCfCfaauaugugugL96 | 2954 | sense | 21 |
| CACACAUAUUGGCAUGCUGACCC | 1859 | csAfscacAfuAfUfuggcAfuGfcugacscsc | 2955 | antis | 23 |
| UCAGCAUGCCAAUAUGUGUGG | 1860 | uscsagcaUfgCfCfAfauaugugugggL96 | 2956 | sense | 21 |
| CCACACAUAUUGGCAUGCUGACC | 1861 | csCfsacaCfaUfAfuuggCfaUfgcugascsc | 2957 | antis | 23 |
| GAGGGUCAGCAUGCCAAUAUG | 1862 | gsasggguCfaGfCfAfugccaauaugL96 | 2958 | sense | 21 |
| CAUAUUGGCAUGCUGACCCUCUG | 1863 | csAfsuauUfgGfCffaugcUfgAfcccucsusg | 2959 | antis | 23 |

-continued

| Unmodified sequence | SEQ ID NO: | Modified sequence | SEQ ID NO: | strand | Length |
|---|---|---|---|---|---|
| AGAGGGUCAGCAUGCCAAUAU | 1864 | asgsagggUfcAfGfCfaugccaauauL96 | 2960 | sense | 21 |
| AUAUUGGCAUGCUGACCCUCUGU | 1865 | asUfsauuGfgCfAfugcuGfaCfccucusgsu | 2961 | antis | 23 |
| GAUGCUCCGGAAUGUUGCUGA | 1866 | gsasugcuCfcGfGfAfauguugcugaL96 | 2962 | sense | 21 |
| UCAGCAACAUUCCGGAGCAUCCU | 1867 | usCfsagcAfaCfAfuuccGfgAfgcaucscsu | 2963 | antis | 23 |
| AUGCUCCGGAAUGUUGCUGAA | 1868 | asusgcucCfgGfAfAfuguugcugaaL96 | 2964 | sense | 21 |
| UUCAGCAACAUUCCGGAGCAUCC | 1869 | usUfscagCfaAfCfauucCfgGfagcauscsc | 2965 | antis | 23 |
| CAAGGAUGCUCCGGAAUGUUG | 1870 | csasaggaUfgCfUfCfcggaauguugL96 | 2966 | sense | 21 |
| CAACAUUCCGGAGCAUCCUUGGA | 1871 | csAfsacaUfuCfCfggagCfaUfccuugsgsa | 2967 | antis | 23 |
| CCAAGGAUGCUCCGGAAUGUU | 1872 | cscsaaggAfuGfCfUfccggaauguuL96 | 2968 | sense | 21 |
| AACAUUCCGGAGCAUCCUUGGAU | 1873 | asAfscauUfcCfGfgagcAfuCfcuuggsasu | 2969 | antis | 23 |
| GCGUAACAGAUUCAAACUGCC | 1874 | gscsguaaCfaGfAfUfucaaacugccL96 | 2970 | sense | 21 |
| GGCAGUUUGAAUCUGUUACGCAC | 1875 | gsGfscagUfuUfGfaaucUfgUfuacgcsasc | 2971 | antis | 23 |
| CGUAACAGAUUCAAACUGCCG | 1876 | csgsuaacAfgAfUfUfcaaacugccgL96 | 2972 | sense | 21 |
| CGGCAGUUUGAAUCUGUUACGCA | 1877 | csGfsgcaGfuUfUfgaauCfuGfuuacgscsa | 2973 | antis | 23 |
| AUGUGCGUAACAGAUUCAAAC | 1878 | asusgugcGfuAfAfCfagauucaaacL96 | 2974 | sense | 21 |
| GUUUGAAUCUGUUACGCACAUCA | 1879 | gsUfsuugAfaUfCfuguuAfcGfcacauscsa | 2975 | antis | 23 |
| GAUGUGCGUAACAGAUUCAAA | 1880 | gsasugugCfgUfAfAfcagauucaaaL96 | 2976 | sense | 21 |
| UUUGAAUCUGUUACGCACAUCAU | 1881 | usUfsugaAfuCfUfguuaCfgCfacaucsasu | 2977 | antis | 23 |
| AGAGAAGAUGGGCUACAAGGC | 1882 | asgsagaaGfaUfGfGfgcuacaaggcL96 | 2978 | sense | 21 |
| GCCUUGUAGCCCAUCUUCUCUGC | 1883 | gsCfscuuGfuAfGfcccaUfcUfucucusgsc | 2979 | antis | 23 |
| GAGAAGAUGGGCUACAAGGCC | 1884 | gsasgaagAfuGfGfGfcuacaaggccL96 | 2980 | sense | 21 |
| GGCCUUGUAGCCCAUCUUCUCUG | 1885 | gsGfsccuUfgUfAfgcccAfuCfuucucsusg | 2981 | antis | 23 |
| AGGCAGAGAAGAUGGGCUACA | 1886 | asgsgcagAfgAfAfGfaugggcuacaL96 | 2982 | sense | 21 |
| UGUAGCCCAUCUUCUCUGCCUGC | 1887 | usGfsuagCfcCfAfucuuCfuCfugccusgsc | 2983 | antis | 23 |
| CAGGCAGAGAAGAUGGGCUAC | 1888 | csasggcaGfaGfAfAfgaugggcuacL96 | 2984 | sense | 21 |
| GUAGCCCAUCUUCUCUGCCUGCC | 1889 | gsUfsagcCfcAfUfcuucUfcUfgccugscsc | 2985 | antis | 23 |

SEQUENCE LISTING (2985 sequences)

SEQ ID NO: 1 - DNA, 1746 bp, Homo sapiens
ctgggatagcaataacctgtgaaaatgctcccccggctaatttgtatcaatgattatgaacaacatgctaaatcagtacttccaaagtctatatatgactattacaggtctggggcaaatgatgaagaaactttggctgataatattgcagcattttccagatggaagctgtatccaaggatgctccggaatgttgctgaaacagatctgtcgacttctgttttaggacagagggtcagcatgccaatatgtgtgggggctacggccatgcagcgcatggctcatgtggacggcgagcttgccactgtgagagcctgtcagtccctgggaacgggcatgatgttgagttcctgggccacctcctcaattgaagaagtggcggaagctggtcctgaggcacttcgttggctgcaactgtatatctacaaggaccgagaagtcaccaagaagctagtgcggcaggcagagaagatgggctacaaggccatatttgtgacagtggacacaccttacctgggcaaccgtctggatgatgtgcgtaacagattcaaactgccgccacaactcaggatgaaaaattttgaaaccagtactttatcattttctcctgaggaaaattttggagacgacagtggacttgctgcatatgtggctaaagcaatagacccatctatcagctgggaagatatcaaatggctgagaagactgacatcattgccaattgttgcaaagggcattttgagaggtgatgatgccagggaggctgttaaacatggcttgaatgggatcttggtgtcgaatcatggggctcgacaactcgatggggtgccagccactattgatgttctgccagaaattgtggaggctgtggaagggaaggtggaagtcttcctggacgggggtgtgcggaaaggcactgatgttctgaaagctctggctcttggcgccaaggctgtgtttgtggggagaccaatcgtttggggcttagctttccagggggagaaaggtgttcaagatgtcctcgagatactaaaggaagaattccggttggccatggctctgagtgggtgccagaatgtgaaagtcatcgacaagacattggtgaggaaaaatcctttggccgtttccaagatctgacagtgcacaatattttcccatctgtattattttttttcagcatgtattacttgacaaagagacactgtgcagagggtgaccacagtctgtaattccccacttcaatacaaagggtgtcgttcttttccaacaaaatagcaatcccttttatttcattgcttttgacttttcaatgggtgtcctaggaaccttttagaaagaaatggactttcatcctggaaatatattaactgttaaaaagaaaacattgaaaatgtgtttagacaacgtcatcccctggcaggctaaagtgctgtatcctttagtaaaattggaggtagcaaacactaaggtgaaaagataatgatctcattgtttattaacctgtattctgtttacatgtctttaaaacagtggttcttaaattgtaagctcaggttcaaagtgttggtaatgcctgattcacaactttgagaaggtagcactggagagaattggaatgggtggcggtaattggtgatacttctttgaatgtagatttccaatcacatctttagtgtctgaatatatccaaatgttttaggatgtatgttacttcttagagagaaataaagcatttttgggaagaat

SEQ ID NO: 2 - DNA, 2029 bp, Mus musculus
ggttgccctaccctgccacaatgttgcctcgactggtctgcatcagtgattatgaacagcatgtccgatcagtgcttcagaagtcagtgtatgactattacaggtctggggcaaatgatcaggagacgttagctgataacatccaagcattttctagatggaagctctatccacggatgcttcgcaacgttgctgatatcgatctgtcaacttctgttttaggacagagagtcagcatgccaatatgtgttggggctactgccatgcagtgcatggctcacgtggacggggagctggccactgtgcgagcctgtcagaccatgggaactggcatgatgctgagttcttgggctacctcctcaatagaagaagtggcagaagctggcccagaggcacttcgctggatgcaactgtacatctacaaagaccgtgagatcagcagacagatagtgaagcgagctgagaagcagggttacaaggccatatttgtgactgtggacaccccttacctgggcaaccgcattgatgacgtgcggaacaggttcaagctgccaccacaactcaggatgaaaaactttgaaaccaatgatttggcattttctcctaagggaaattttggagacaacagtggacttgctgaatatgtggcacaagctatagacccatctctcagctgggatgatattacatggctcagacgattgacatcactgcctattgttgtaaagggcattttgagaggtgatgatgccaaggaagctgttaaacatggtgtggatgggatcttggtgtcgaatcatggggcgcgacaactggatggggtgccagctactattgatgtcctgccagagattgttgaggctgtggaagggaaggtagaagtcttcctggatgggggagtaaggaaaggtactgatgttctcaaagctctggccctaggagccaaggccgtttttgtgggaagacccatcatctggggcttggctttccagggggagaaaggtttcaagatgtcctcgagatattgaaggaagaattccgactggccatggctctgagtgggtgccagaatgtggaaagtcatcgacaagacattggtgaggaaaaatcctttggctgtttccaagatctgacagtgcacaatattttcccatctgtattattttttttccagcgtggattacttgacaaagagacactgtgcagagggtgaccacagactgtaactccccacttctatacaaagggtgtcgttcttttccaacaaaatagccaccccttttccttcattgcttttgacttttcaatgggtgtcctaggaaccttctagaaagaaatggacttgcatcctggaaatatattaactgttaaaaagaaaacattgaaaatgtgtttgggcaacgtcatcccctggcaggctaaagtgctggggaacaaaagatatcctctggtgagattgcaggtagcatgctgaagtgaaagatactgacctcactgttcattaacctgtcttctgtttagatttccttaagacagtggctcttacagtttgcacttggctttgaaatgctggaaatgcccagagaaacatgaggtttggatttgccatgttgagaaaatagcaccaggtagaattgaaatggatggtggtaatttgtgattttttttctagaaacttttcattttttaacaccctatttttttgaaggtagatttttagctatatatcacacgtctgaatatgtctggatgttttgtggcactcattgcatttgaaagggatgtgtctagtccagttgggaccacatggagctatttttacttttgaactttgtctcctcattctcattttaaaataagtgttgacttcctaattcctcttgaatcttttttgattttctcacttttcctcatttatagtcacattcagtgtaaagtacatattttgtggggtccgtgatgaataaagatttgaaattcttgttcagaaggaaggcaaaaaaaaaaaaaagtctttccttttatcaca

SEQ ID NO: 3 - DNA, 1746 bp, Homo sapiens
attcttcccaaaaatgctttatttctctctaagaagtaacatacatcctaaaacatttggatatattcagacactaaagatgtgattggaaatctacattcaaagaagtatcaccaattaccgccacccattccaattctctccagtgctaccttctcaaagttgtgaatcaggcattaccaacactttgaacctgagcttacaatttaagaaccactgttttaaagacatgtaaacagaatacaggttaataaacaatgagatcattatcttttcaccttagtgtttgctacctccaattttactaaaggatacagcactttagcctgccaggggatgacgttgtctaaacacattttcaatgttttctttttaacagttaatatatttccaggatgaaagtccatttctttctaaaaggttcctaggacacccattgaaaagtcaaaagcaatgaaataaaagggattgctattttgttggaaaagaacgacaccctttgtattgaagtggggaattacagactgtggtcaccctctgcacagtgtctctttgtcaagtaatacatgctgaaaaaaaataatacagatgggaaaatattgtgcactgtcagatcttggaaacggccaaaggatttttcctcaccaatgtcttgtcgatgactttcacattctggcacccactcagagccatggccaaccggaattcttcctttagtatctcgaggacatcttgaacacctttctccccctggaaagctaagccccaaacgattggtctccccacaaacacagccttggcgccaagagccagagctttcagaacatcagtgcctttccgcacacccccgtccaggaagacttccaccttcccttccacagcctccacaatttctggcagaacatcaatagtggctggcaccccatcgagttgtcgagccccatgattcgacaccaagatcccattcaagccatgtttaacagcctccctggcatcatcacctctcaaaatgccctttgcaacaattggcaatgatgtcagtcttctcagccatttgatatcttcccagctgatagatgggtctattgctttagccacatatgcagcaagtccactgtcgtctccaaaattttcctcaggagaaaatgataaagtactggtttcaaaatttttcatcctgagttgtggcggcagtttgaatctgttacgcacatcatccagacggttgcccaggtaaggtgtgtccactgtcacaaatatggccttgtagcccatcttctctgcctgccgcactagcttcttggtgacttctcggtccttgtagatatacagttgcagccaacgaagtgcctcaggaccagcttccgccacttcttcaattgaggaggtggcccaggaactcaacatcatgcccgttcccagggactgacaggctctcacagtggcaagctcgccgtccacatgagccatgcgctgcatggccgtagcccccacacatattggcatgctgaccctctgtcctaaaacagaagtcgacagatctgtttcagcaacattccggagcatccttggatacagcttccatctggaaaatgctgcaatattatcagccaaagtttcttcatcatttgccccagacctgtaatagtcatatatagactttggaagtactgatttagcatgttgttcataatcattgatacaaattagccgggggagcattttcacaggttattgctatcccag

SEQ ID NO: 4 - DNA, 2029 bp, Mus musculus
tgtgataaaaggaaagacttttttttttttttgccttccttctgaacaagaatttcaaatctttattcatcacggaccccacaaaatatgtactttacactgaatgtgactataaatgaggaaaagtgagaaaatcaaaaaagattcaagaggaattaggaagtcaacacttattttaaaatgagaatgaggagacaaagttcaaaagtaaaaatagctccatgtggtcccaactggactagacacatccctttcaaatgcaatgagtgccacaaaacatccagacatattcagacgtgtgatatatagctaaaaatctaccttcaaaaaaatagggtgttaaaaaatgaaaagtttctagaaaaaaaatcacaaattaccaccatccatttcaattctacctggtgctattttctcaacatggcaaatccaaacctcatgtttctctgggcatttccagcatttcaaagccaagtgcaaactgtaagagccactgtcttaaggaaatctaaacagaagacaggttaatgaacagtgaggtcagtatctttcacttcagcatgctacctgcaatctcaccagaggatatcttttgttccccagcactttagcctgccaggggatgacgttgcccaaacacattttcaatgttttctttttaacagttaatatatttccaggatgcaagtccatttctttctagaaggttcctaggacacccattgaaaagtcaaaagcaatgaaggaaaaggggtggctattttgttggaaaagaacgacaccctttgtatagaagtggggagttacagtctgtggtcaccctctgcacagtgtctctttgtcaagtaatccacgctggaaaaaaaataatacagatgggaaaatattgtgcactgtcagatcttggaaacagccaaaggatttttcctcaccaatgtcttgtcgatgactttcacattctggcacccactcagagccatggccagtcggaattcttccttcaatatctcgaggacatcttgaacacctttctccccctggaaagccaagccccagatgatgggtcttcccacaaaaacggccttggctcctagggccagagctttgagaacatcagtacctttccttactcccccatccaggaagacttctaccttcccttccacagcctcaacaatctctggcaggacatcaatagtagctggcaccccatccagttgtcgcgccccatgattcgacaccaagatcccatccacaccatgtttaacagcttccttggcatcatcacctctcaaaatgccctttacaacaataggcagtgatgtcaatcgtctgagccatgtaatatcatcccagctgagagatgggtctatagcttgtgccacatattcagcaagtccactgttgtctccaaaatttcccttaggagaaaatgccaaatcattggtttcaaagtttttcatcctgagttgtggtggcagcttgaacctgttccgcacgtcatcaatgcggttgcccaggtaaggggtgtccacagtcacaaatatggccttgtaaccctgcttctcagctcgcttcactatctgtctgctgatctcacggtctttgtagatgtacagttgcatccagcgaagtgcctctgggccagcttctgccacttcttctattgaggaggtagcccaagaactcagcatcatgccagttcccatggtctgacaggctcgcacagtggccagctccccgtccacgtgagccatgcactgcatggcagtagccccaacacatattggcatgctgactctctgtcctaaaacagaagttgacagatcgatatcagcaacgttgcgaagcatccgtggatagagcttccatctagaaaatgcttggatgttatcagctaacgtctcctgatcatttgccccagacctgtaatagtcatacactgacttctgaagcactgatcggacatgctgttcataatcactgatgcagaccagtcgaggcaacattgtggcagggtagggcaacc

SEQ ID NO: 5 - DNA, 1801 bp, Macaca fascicularis
gtgaggatgtagaaagcaatacattaaaaaaaacccaaaaaactccatctgggataacaataacctgtgaaaatgctcccccggctaatttgtatcaatgattatgaacaacatgctaaatcagtacttccaaagtctatatatgactattataggtctggagcaaatgatgaagaaactttggccgataatgttgcagcattttccagatggaagctgtatccaaggatgctccggaatgttgctgaaacagatctgtcgacttctgttttaggacagagggtcagcatgccaatatgcgtgggggccacggccatgcagcgcatggctcatgtggatggcgagcttgccactgtgcgagcctgtcagtccctgggaacgggcatgatgttgagttcctgggccacctcctcaattgaagaagtggcagaagctggtcctgaggcacttcgttggttgtaactgtatatctataaggaccgagaagtcaccaagaagctggtgcagcaggcagagaagacgggctacaaggccatatttgtgacagtggacacaccttacctgggcaaccgtcttgatgatgtacgtaacagattcaagctgccaccacaactcaggatgaaaaattttgaaaccagtactttatcattttctcctgaggaaaattttggagatgacagtggacttgctgcatatgtggctaaagcgatagacccatctatcagctgggaagatatcaaatggctgagaagactgacgtcattgccaattgttgcaaagggcattttgagaggtgatgatgccagggaggctgttaaacatggcttgaatgggatcttggtgtcgaatcatggggctcgacaactcgatggggtgccagccactattgatgttctgccagaaattgtggaggccgtggaagggaaggtggaagtcttcctggacgggggtgtgcggaaaggcactgatgttctgaaagctctggctcttggcgccaaggctgtgtttgtggggagaccaatcatttggggcttagctttccagggggagaaaggtgttcaagatgtccttgagatactaaaggaagaattccggttggccatggctttgagtgggtgccagaatgtgaaagtcatcgacaagacattggtgaggaaaaatcctttggccgtttccaagatctgacagtgcacaatattttcccatctgtattatttttttttcagcatgtattacttgacaaagagacactgtgcagagggtgaccacagtctgtaattccccacttcaatacaaaggatgtcgttcttttccaacaaaatagcaatcccttttagttcattgcttttgacttttcaatgggtgtcctaggaaccttttagaaagaaatggactttcatcctggaaatatattaactgttaaaaagaaaacattgaaaatgtgtttagacaacgtcatcctctggcaggctaaagtactgtatcctttagtaaaattggaggtagcaaacactaaggtgaaaagataatgatctcattgtttattaacctgtattctgtttagatgtctttaaaacagtggttcttaaattgtaagctcaggttcaaagcattggaaatgcctgattgacaacattgagaaggtagccctggatagaattggaatggatggcagtaactggtgatacttctttgaatgcagctttccaatcacatctttagtgtctgaatatatccaaatgttttaggatatatgttacttcttaatcagagagaaataaagcattttttgggaaggata

SEQ ID NO: 6 - DNA, 1936 bp, Rattus norvegicus
atactgccttgctggctttggaaattctagagtttctgaggcatagtagacttggtgacctccaagttctaaccgagcagaaagagtctcatggcttctgtgactactatagtggaagctctatccacggatgctgcgcaacgttgctgatatcgacctgtcgacttctgttttaggacagagagtgagcatgccaatatgcgttggggctacggctatgcagtgcatggctcatgtggatggggagctggccactgttcgagcctgtcagaccatgggaactggcatgatgttgagttcctgggccacttcctcaatagaagaggtggcagaggctggcccggaggcacttcgctggatgcaactctacatctacaaagatcgtgaggtcagcagtcagctagtgaagagggctgagcagatgggttacaaggccatatttgtgactgtggacaccccttacctgggaaatcgcttcgatgatgtgcggaacaggttcaagctaccaccacagctcaggatgaaaaactttgaaaccaacgatttggcattttctcctaaggggaattttggagacaacagtggccttgctgaatatgtggcacaagccatagacccatctctcagctgggatgatattaaatggctcagacggttgacctcactgcccattgttgtaaagggaattttgagaggtgatgatgcccaggaagctgttaaacatggtgtggatgggatcttagtgtcgaatcatggggcacgacaactggatggggtgccagctactattgatgccctgccagagatcgttgaggctgtggaagggaaggtagaagtcttcctggatgggggagtcaggaaaggcaccgatgttctcaaagctctggccctgggagccagagctgtttttgtggggagacccatcatctggggcttggctttccagggggagaaaggtgttcaagatgtcctcgagatactgaaggaagagttccggctggccatggctctgagtgggtgccagaatgtgaaagtcatcgacaagacattggtgaggaaaaatcctttggctgtttccaagatctgacagtgcacaatattttcccatctgtattatttttttccagcatggattacttgacaaagagacactgtgcagagggtgaccacagactgtaactccccacttcaacacaaagggtgtcgttcttttccaacaaaatagccaccccttctccttcattgcttttgacttttcaatgggtgtcctaggaaccttctagaaagaaatggacttgcatcctggaaatatattaactgttaaaaagaaaacattgaaaatgtgtttgggcaacgtcatcccctggcaggctaaagtgagggggaacaaaagatatcctctggtgagattggaggtagcatgccgaagtaaaagacactgacctcactgtttattaacctgtcttctgtttagatttccttaagacagtggctcttacagtgtgcgctgggctttgaaatgccggaaatgcccagagaaacatggggtttggatttgccgtgttgagaaaatagcacccgatagaattgaaacggatggtggtaatttgtgatttttctagagacttttcattttttaacaccctatttctttgaaggtggatttctagctatatatcgcatgtctgaatatgtctggctgttttgtggcactcactgtgtttgaaaggaatgtgtctagtccacttgggaccatgcaaagttattttatttttgaactctgtctcttcattcccattttaaagtaagtgttgacttcctaattccccttgaatcatttttattttctcacttctcatttatagtcacattcagtgtcaagtatatattttgtggggtccatggtgaataaagctttaaaattcttgtccagaaa

SEQ ID NO: 7 - DNA, 1801 bp, Macaca fascicularis
tatccttcccaaaaaatgctttatttctctctgattaagaagtaacatatatcctaaaacatttggatatattcagacactaaagatgtgattggaaagctgcattcaaagaagtatcaccagttactgccatccattccaattctatccagggctaccttctcaatgttgtcaatcaggcatttccaatgctttgaacctgagcttacaatttaagaaccactgttttaaagacatctaaacagaatacaggttaataaacaatgagatcattatcttttcaccttagtgtttgctacctccaattttactaaaggatacagtactttagcctgccagaggatgacgttgtctaaacacattttcaatgttttctttttaacagttaatatatttccaggatgaaagtccatttctttctaaaaggttcctaggacacccattgaaaagtcaaaagcaatgaactaaaagggattgctattttgttggaaaagaacgacatcctttgtattgaagtggggaattacagactgtggtcaccctctgcacagtgtctctttgtcaagtaatacatgctgaaaaaaaaataatacagatgggaaaatattgtgcactgtcagatcttggaaacggccaaaggatttttcctcaccaatgtcttgtcgatgactttcacattctggcacccactcaaagccatggccaaccggaattcttcctttagtatctcaaggacatcttgaacacctttctccccctggaaagctaagccccaaatgattggtctccccacaaacacagccttggcgccaagagccagagctttcagaacatcagtgcctttccgcacacccccgtccaggaagacttccaccttcccttccacggcctccacaatttctggcagaacatcaatagtggctggcaccccatcgagttgtcgagccccatgattcgacaccaagatcccattcaagccatgtttaacagcctccctggcatcatcacctctcaaaatgccctttgcaacaattggcaatgacgtcagtcttctcagccatttgatatcttcccagctgatagatgggtctatcgctttagccacatatgcagcaagtccactgtcatctccaaaattttcctcaggagaaaatgataaagtactggtttcaaaatttttcatcctgagttgtggtggcagcttgaatctgttacgtacatcatcaagacggttgcccaggtaaggtgtgtccactgtcacaaatatggccttgtagcccgtcttctctgcctgctgcaccagcttcttggtgacttctcggtccttatagatatacagttacaaccaacgaagtgcctcaggaccagcttctgccacttcttcaattgaggaggtggcccaggaactcaacatcatgcccgttcccagggactgacaggctcgcacagtggcaagctcgccatccacatgagccatgcgctgcatggccgtggcccccacgcatattggcatgctgaccctctgtcctaaaacagaagtcgacagatctgtttcagcaacattccggagcatccttggatacagcttccatctggaaaatgctgcaacattatcggccaaagtttcttcatcatttgctccagacctataatagtcatatatagactttggaagtactgatttagcatgttgttcataatcattgatacaaattagccgggggagcattttcacaggttattgttatcccagatggagttttttgggttttttttaatgtattgctttctacatcctcac

SEQ ID NO: 8 - DNA, 1936 bp, Macaca fascicularis
tttctggacaagaattttaaagctttattcaccatggaccccacaaaatatatacttgacactgaatgtgactataaatgagaagtgagaaaataaaaatgattcaaggggaattaggaagtcaacacttactttaaaatgggaatgaagagacagagttcaaaaataaaataactttgcatggtcccaagtggactagacacattcctttcaaacacagtgagtgccacaaaacagccagacatattcagacatgcgatatatagctagaaatccaccttcaaagaaatagggtgttaaaaaatgaaaagtctctagaaaaatcacaaattaccaccatccgtttcaattctatcgggtgctattttctcaacacggcaaatccaaaccccatgtttctctgggcatttccggcatttcaaagcccagcgcacactgtaagagccactgtcttaaggaaatctaaacagaagacaggttaataaacagtgaggtcagtgtcttttacttcggcatgctacctccaatctcaccagaggatatcttttgttccccctcactttagcctgccaggggatgacgttgcccaaacacattttcaatgttttctttttaacagttaatatatttccaggatgcaagtccatttctttctagaaggttcctaggacacccattgaaaagtcaaaagcaatgaaggagaaggggtggctattttgttggaaaagaacgacaccctttgtgttgaagtggggagttacagtctgtggtcaccctctgcacagtgtctctttgtcaagtaatccatgctggaaaaaaataatacagatgggaaaatattgtgcactgtcagatcttggaaacagccaaaggatttttcctcaccaatgtcttgtcgatgactttcacattctggcacccactcagagccatggccagccggaactcttccttcagtatctcgaggacatcttgaacacctttctccccctggaaagccaagccccagatgatgggtctccccacaaaaacagctctggctcccagggccagagctttgagaacatcggtgcctttcctgactcccccatccaggaagacttctaccttcccttccacagcctcaacgatctctggcagggcatcaatagtagctggcaccccatccagttgtcgtgccccatgattcgacactaagatcccatccacaccatgtttaacagcttcctgggcatcatcacctctcaaaattccctttacaacaatgggcagtgaggtcaaccgtctgagccatttaatatcatcccagctgagagatgggtctatggcttgtgccacatattcagcaaggccactgttgtctccaaaattccccttaggagaaaatgccaaatcgttggtttcaaagtttttcatcctgagctgtggtggtagcttgaacctgttccgcacatcatcgaagcgatttcccaggtaaggggtgtccacagtcacaaatatggccttgtaacccatctgctcagccctcttcactagctgactgctgacctcacgatctttgtagatgtagagttgcatccagcgaagtgcctccgggccagcctctgccacctcttctattgaggaagtggcccaggaactcaacatcatgccagttcccatggtctgacaggctcgaacagtggccagctccccatccacatgagccatgcactgcatagccgtagccccaacgcatattggcatgctcactctctgtcctaaaacagaagtcgacaggtcgatatcagcaacgttgcgcagcatccgtggatagagcttccactatagtagtcacagaagccatgagactctttctgctcggttagaacttggaggtcaccaagtctactatgcctcagaaactctagaatttccaaagccagcaaggcagtat

SEQ ID NO: 9 - protein, 16 aa, Unknown
  Description of Unknown: RFGF peptide
AAVALLPAVLLALLAP

SEQ ID NO: 10 - protein, 11 aa, Unknown
  Description of Unknown: RFGF analogue peptide
AALLPVLLAAP

SEQ ID NO: 11 - protein, 13 aa, Human immunodeficiency virus
GRKKRRQRRRPPQ

SEQ ID NO: 12 - protein, 16 aa, Drosophila sp.
RQIKIWFQNRRMKWKK

SEQ ID NO: 13 - DNA, 19 bp, Artificial Sequence
  Description of Artificial Sequence: Synthetic probe
gcatcctgggctacactga

SEQ ID NO: 14 - DNA, 20 bp, Artificial Sequence
  Description of Artificial Sequence: Synthetic probe
tgggtgtcgctgttgaagtc

SEQ ID NO: 15 - DNA, 16 bp, Artificial Sequence
  Description of Artificial Sequence: Synthetic probe
ccaggtggtctcctcc

SEQ ID NO: 16 - DNA, 21 bp, Artificial Sequence
  Description of Artificial Sequence: Synthetic oligonucleotide
  Description of Combined DNA/RNA Molecule: Synthetic oligonucleotide
cuuacgcugaguacuucgatt

SEQ ID NO: 17 - DNA, 21 bp, Artificial Sequence
  Description of Artificial Sequence: Synthetic oligonucleotide
  Description of Combined DNA/RNA Molecule: Synthetic oligonucleotide
ucgaaguacucagcguaagtt

SEQ ID NO: 18 - RNA, 21 nt, Artificial Sequence
  Description of Artificial Sequence: Synthetic oligonucleotide
gaaugugaaagucaucgacaa

SEQ ID NO: 19 - RNA, 21 nt, Artificial Sequence
  Description of Artificial Sequence: Synthetic oligonucleotide
uuuucaauggguguccuagga

SEQ ID NO: 20 - RNA, 21 nt, Artificial Sequence
  Description of Artificial Sequence: Synthetic oligonucleotide
gaaagucaucgacaagacauu

SEQ ID NO: 21 - RNA, 21 nt, Artificial Sequence
  Description of Artificial Sequence: Synthetic oligonucleotide
ucaucgacaagacauugguga

SEQ ID NO: 22 - RNA, 21 nt, Artificial Sequence
  Description of Artificial Sequence: Synthetic oligonucleotide
uuucaauggguguccuaggaa

SEQ ID NO: 23 - RNA, 21 nt, Artificial Sequence
  Description of Artificial Sequence: Synthetic oligonucleotide
aauggguguccuaggaaccuu

SEQ ID NO: 24 - RNA, 21 nt, Artificial Sequence
  Description of Artificial Sequence: Synthetic oligonucleotide
gacagugcacaauauuuucca

SEQ ID NO: 25 - RNA, 21 nt, Artificial Sequence
  Description of Artificial Sequence: Synthetic oligonucleotide
acuuuucaauggguguccuaa

SEQ ID NO: 26 - RNA, 21 nt, Artificial Sequence
  Description of Artificial Sequence: Synthetic oligonucleotide
aagucaucgacaagacauuga

SEQ ID NO: 27 - RNA, 21 nt, Artificial Sequence
  Description of Artificial Sequence: Synthetic oligonucleotide
aucgacaagacauuggugaga

SEQ ID NO: 28 - RNA, 21 nt, Artificial Sequence
  Description of Artificial Sequence: Synthetic oligonucleotide
gggagaaagguguucaagaua

SEQ ID NO: 29 - RNA, 21 nt, Artificial Sequence
  Description of Artificial Sequence: Synthetic oligonucleotide
cuuuucaauggguguccuaga

SEQ ID NO: 30 - RNA, 21 nt, Artificial Sequence
  Description of Artificial Sequence: Synthetic oligonucleotide
ucaauggguguccuaggaaca

SEQ ID NO: 31 - RNA, 21 nt, Artificial Sequence
  Description of Artificial Sequence: Synthetic oligonucleotide
uugacuuuucaauggguguca

SEQ ID NO: 32 - RNA, 21 nt, Artificial Sequence
  Description of Artificial Sequence: Synthetic oligonucleotide
aaagucaucgacaagacauua

SEQ ID NO: 33 - RNA, 21 nt, Artificial Sequence
  Description of Artificial Sequence: Synthetic oligonucleotide
cagggggagaaagguguucaa

SEQ ID NO: 34 - RNA, 21 nt, Artificial Sequence
  Description of Artificial Sequence: Synthetic oligonucleotide
cauuggugaggaaaaauccuu

SEQ ID NO: 35 - RNA, 21 nt, Artificial Sequence
  Description of Artificial Sequence: Synthetic oligonucleotide
acauuggugaggaaaaauccu

SEQ ID NO: 36 - RNA, 21 nt, Artificial Sequence
  Description of Artificial Sequence: Synthetic oligonucleotide
agggggagaaagguguucaaa

SEQ ID NO: 37 - RNA, 21 nt, Artificial Sequence
  Description of Artificial Sequence: Synthetic oligonucleotide
auggugguaauuugugauuuu

SEQ ID NO: 38 - RNA, 21 nt, Artificial Sequence
  Description of Artificial Sequence: Synthetic oligonucleotide
gacuugcauccuggaaauaua

SEQ ID NO: 39 - RNA, 21 nt, Artificial Sequence
  Description of Artificial Sequence: Synthetic oligonucleotide
ggaagggaagguagaagucuu

SEQ ID NO: 40 - RNA, 21 nt, Artificial Sequence
  Description of Artificial Sequence: Synthetic oligonucleotide
ugucuucuguuuagauuuccu

SEQ ID NO: 41 - RNA, 21 nt, Artificial Sequence
  Description of Artificial Sequence: Synthetic oligonucleotide
cuuuggcuguuuccaagaucu

SEQ ID NO: 42 - RNA, 21 nt, Artificial Sequence
  Description of Artificial Sequence: Synthetic oligonucleotide
aauguguuugggcaacgucau

SEQ ID NO: 43 - RNA, 21 nt, Artificial Sequence
  Description of Artificial Sequence: Synthetic oligonucleotide
ugugacuguggacaccccuua

SEQ ID NO: 44 - RNA, 21 nt, Artificial Sequence
  Description of Artificial Sequence: Synthetic oligonucleotide
gauggggugccagcuacuauu

SEQ ID NO: 45 - RNA, 21 nt, Artificial Sequence
  Description of Artificial Sequence: Synthetic oligonucleotide
gaaaauguguuugggcaacgu

SEQ ID NO: 46 - RNA, 21 nt, Artificial Sequence
  Description of Artificial Sequence: Synthetic oligonucleotide
ggcuguuuccaagaucugaca

SEQ ID NO: 47 - RNA, 21 nt, Artificial Sequence
  Description of Artificial Sequence: Synthetic oligonucleotide
uccaacaaaauagccaccccu

SEQ ID NO: 48 - RNA, 21 nt, Artificial Sequence
  Description of Artificial Sequence: Synthetic oligonucleotide
gucuucuguuuagauuuccuu

SEQ ID NO: 49 - RNA, 21 nt, Artificial Sequence
  Description of Artificial Sequence: Synthetic oligonucleotide
uggaagggaagguagaagucu

SEQ ID NO: 50 - RNA, 21 nt, Artificial Sequence
  Description of Artificial Sequence: Synthetic oligonucleotide
uccuuuggcuguuuccaagau

SEQ ID NO: 51 - RNA, 21 nt, Artificial Sequence
  Description of Artificial Sequence: Synthetic oligonucleotide
caucucucagcugggaugaua

SEQ ID NO: 52 - RNA, 21 nt, Artificial Sequence
  Description of Artificial Sequence: Synthetic oligonucleotide
ggggugccagcuacuauugau

SEQ ID NO: 53 - RNA, 21 nt, Artificial Sequence
  Description of Artificial Sequence: Synthetic oligonucleotide
auguguuugggcaacgucaua

SEQ ID NO: 54 - RNA, 21 nt, Artificial Sequence
  Description of Artificial Sequence: Synthetic oligonucleotide
cuguuuagauuuccuuaagaa

SEQ ID NO: 55 - RNA, 21 nt, Artificial Sequence
  Description of Artificial Sequence: Synthetic oligonucleotide
agaaagaaauggacuugcaua

SEQ ID NO: 56 - RNA, 21 nt, Artificial Sequence
  Description of Artificial Sequence: Synthetic oligonucleotide
gcauccuggaaauauauuaaa

SEQ ID NO: 57 - RNA, 21 nt, Artificial Sequence
  Description of Artificial Sequence: Synthetic oligonucleotide
ccugucagaccaugggaacua

SEQ ID NO: 58 - RNA, 21 nt, Artificial Sequence
  Description of Artificial Sequence: Synthetic oligonucleotide
aaacaugguguggaugggaua

SEQ ID NO: 59 - RNA, 21 nt, Artificial Sequence
  Description of Artificial Sequence: Synthetic oligonucleotide
cucaggaugaaaaauuuugaa

SEQ ID NO: 60 - RNA, 21 nt, Artificial Sequence
  Description of Artificial Sequence: Synthetic oligonucleotide
cagcauguauuacuugacaaa

SEQ ID NO: 61 - RNA, 21 nt, Artificial Sequence
  Description of Artificial Sequence: Synthetic oligonucleotide
uaugaacaacaugcuaaauca

SEQ ID NO: 62 - RNA, 21 nt, Artificial Sequence
  Description of Artificial Sequence: Synthetic oligonucleotide
auauauccaaauguuuuagga

SEQ ID NO: 63 - RNA, 21 nt, Artificial Sequence
  Description of Artificial Sequence: Synthetic oligonucleotide
ccagauggaagcuguauccaa

SEQ ID NO: 64 - RNA, 21 nt, Artificial Sequence
  Description of Artificial Sequence: Synthetic oligonucleotide
gacuuucauccuggaaauaua

SEQ ID NO: 65 - RNA, 21 nt, Artificial Sequence
  Description of Artificial Sequence: Synthetic oligonucleotide
ccccggcuaauuuguaucaau

SEQ ID NO: 66 - RNA, 21 nt, Artificial Sequence
  Description of Artificial Sequence: Synthetic oligonucleotide
uuaaacauggcuugaauggga

SEQ ID NO: 67 - RNA, 21 nt, Artificial Sequence
  Description of Artificial Sequence: Synthetic oligonucleotide
aauguguuuagacaacgucau

SEQ ID NO: 68 - RNA, 21 nt, Artificial Sequence
  Description of Artificial Sequence: Synthetic oligonucleotide
acuaaaggaagaauuccgguu

SEQ ID NO: 69 - RNA, 21 nt, Artificial Sequence
  Description of Artificial Sequence: Synthetic oligonucleotide
uauauccaaauguuuuaggau

SEQ ID NO: 70 - RNA, 21 nt, Artificial Sequence
  Description of Artificial Sequence: Synthetic oligonucleotide
gugcggaaaggcacugauguu

SEQ ID NO: 71 - RNA, 21 nt, Artificial Sequence
  Description of Artificial Sequence: Synthetic oligonucleotide
uaaaacagugguucuuaaauu

SEQ ID NO: 72 - RNA, 21 nt, Artificial Sequence
  Description of Artificial Sequence: Synthetic oligonucleotide
augaaaaauuuugaaaccagu

SEQ ID NO: 73 - RNA, 21 nt, Artificial Sequence
  Description of Artificial Sequence: Synthetic oligonucleotide
aacaaaauagcaaucccuuuu

SEQ ID NO: 74 - RNA, 21 nt, Artificial Sequence
  Description of Artificial Sequence: Synthetic oligonucleotide
cugaaacagaucugucgacuu

SEQ ID NO: 75 - RNA, 21 nt, Artificial Sequence
  Description of Artificial Sequence: Synthetic oligonucleotide
uuguugcaaagggcauuuuga

SEQ ID NO: 76 - RNA, 21 nt, Artificial Sequence
  Description of Artificial Sequence: Synthetic oligonucleotide
cucauuguuuauuaaccugua

SEQ ID NO: 77 - RNA, 21 nt, Artificial Sequence
  Description of Artificial Sequence: Synthetic oligonucleotide
caacaaaauagcaaucccuuu

SEQ ID NO: 78 - RNA, 21 nt, Artificial Sequence
  Description of Artificial Sequence: Synthetic oligonucleotide
cauuguuuauuaaccuguauu

SEQ ID NO: 79 - RNA, 21 nt, Artificial Sequence
  Description of Artificial Sequence: Synthetic oligonucleotide
uaucagcugggaagauaucaa

SEQ ID NO: 80 - RNA, 21 nt, Artificial Sequence
  Description of Artificial Sequence: Synthetic oligonucleotide
uguccuaggaaccuuuuagaa

SEQ ID NO: 81 - RNA, 21 nt, Artificial Sequence
  Description of Artificial Sequence: Synthetic oligonucleotide
uccaacaaaauagcaaucccu

SEQ ID NO: 82 - RNA, 21 nt, Artificial Sequence
  Description of Artificial Sequence: Synthetic oligonucleotide
ggugugcggaaaggcacugau

SEQ ID NO: 83 - RNA, 21 nt, Artificial Sequence
  Description of Artificial Sequence: Synthetic oligonucleotide
uugaaaccaguacuuuaucau

SEQ ID NO: 84 - RNA, 21 nt, Artificial Sequence
  Description of Artificial Sequence: Synthetic oligonucleotide
uacuuccaaagucuauauaua

SEQ ID NO: 85 - RNA, 21 nt, Artificial Sequence
  Description of Artificial Sequence: Synthetic oligonucleotide
uccuaggaaccuuuuagaaau

SEQ ID NO: 86 - RNA, 21 nt, Artificial Sequence
  Description of Artificial Sequence: Synthetic oligonucleotide
cuccugaggaaaauuuuggaa

SEQ ID NO: 87 - RNA, 21 nt, Artificial Sequence
  Description of Artificial Sequence: Synthetic oligonucleotide
gcuccggaauguugcugaaau

SEQ ID NO: 88 - RNA, 21 nt, Artificial Sequence
  Description of Artificial Sequence: Synthetic oligonucleotide
guguuuguggggagaccaaua

SEQ ID NO: 89 - RNA, 23 nt, Artificial Sequence
  Description of Artificial Sequence: Synthetic oligonucleotide
uugucgaugacuuucacauucug

SEQ ID NO: 90 - RNA, 23 nt, Artificial Sequence
  Description of Artificial Sequence: Synthetic oligonucleotide
uccuaggacacccauugaaaagu

SEQ ID NO: 91 - RNA, 23 nt, Artificial Sequence
  Description of Artificial Sequence: Synthetic oligonucleotide
aaugucuugucgaugacuuucac

SEQ ID NO: 92 - RNA, 23 nt, Artificial Sequence
  Description of Artificial Sequence: Synthetic oligonucleotide
ucaccaaugucuugucgaugacu

SEQ ID NO: 93 - RNA, 23 nt, Artificial Sequence
  Description of Artificial Sequence: Synthetic oligonucleotide
uuccuaggacacccauugaaaag

SEQ ID NO: 94 - RNA, 23 nt, Artificial Sequence
  Description of Artificial Sequence: Synthetic oligonucleotide
aagguuccuaggacacccauuga

SEQ ID NO: 95 - RNA, 23 nt, Artificial Sequence
  Description of Artificial Sequence: Synthetic oligonucleotide
uggaaaauauugugcacugucag

SEQ ID NO: 96 - RNA, 23 nt, Artificial Sequence
  Description of Artificial Sequence: Synthetic oligonucleotide
uuaggacacccauugaaaaguca

SEQ ID NO: 97 - RNA, 23 nt, Artificial Sequence
  Description of Artificial Sequence: Synthetic oligonucleotide
ucaaugucuugucgaugacuuuc

SEQ ID NO: 98 - RNA, 23 nt, Artificial Sequence
  Description of Artificial Sequence: Synthetic oligonucleotide
ucucaccaaugucuugucgauga

SEQ ID NO: 99 - RNA, 23 nt, Artificial Sequence
  Description of Artificial Sequence: Synthetic oligonucleotide
uaucuugaacaccuuucuccccc

SEQ ID NO: 100 - RNA, 23 nt, Artificial Sequence
  Description of Artificial Sequence: Synthetic oligonucleotide
ucuaggacacccauugaaaaguc

SEQ ID NO: 101 - RNA, 23 nt, Artificial Sequence
  Description of Artificial Sequence: Synthetic oligonucleotide
uguuccuaggacacccauugaaa

SEQ ID NO: 102 - RNA, 23 nt, Artificial Sequence
  Description of Artificial Sequence: Synthetic oligonucleotide
ugacacccauugaaaagucaaaa

SEQ ID NO: 103 - RNA, 23 nt, Artificial Sequence
  Description of Artificial Sequence: Synthetic oligonucleotide
uaaugucuugucgaugacuuuca

SEQ ID NO: 104 - RNA, 23 nt, Artificial Sequence
  Description of Artificial Sequence: Synthetic oligonucleotide
uugaacaccuuucucccccugga

SEQ ID NO: 105 - RNA, 23 nt, Artificial Sequence
  Description of Artificial Sequence: Synthetic oligonucleotide
aaggauuuuuccucaccaauguc

SEQ ID NO: 106 - RNA, 23 nt, Artificial Sequence
  Description of Artificial Sequence: Synthetic oligonucleotide
aggauuuuuccucaccaaugucu

SEQ ID NO: 107 - RNA, 23 nt, Artificial Sequence
  Description of Artificial Sequence: Synthetic oligonucleotide
uuugaacaccuuucucccccugg

SEQ ID NO: 108 - RNA, 23 nt, Artificial Sequence
  Description of Artificial Sequence: Synthetic oligonucleotide
aaaaucacaaauuaccaccaucc

SEQ ID NO: 109 - RNA, 23 nt, Artificial Sequence
  Description of Artificial Sequence: Synthetic oligonucleotide
uauauuuccaggaugcaagucca

SEQ ID NO: 110 - RNA, 23 nt, Artificial Sequence
  Description of Artificial Sequence: Synthetic oligonucleotide
aagacuucuaccuucccuuccac

SEQ ID NO: 111 - RNA, 23 nt, Artificial Sequence
  Description of Artificial Sequence: Synthetic oligonucleotide
aggaaaucuaaacagaagacagg

SEQ ID NO: 112 - RNA, 23 nt, Artificial Sequence
  Description of Artificial Sequence: Synthetic oligonucleotide
agaucuuggaaacagccaaagga

SEQ ID NO: 113 - RNA, 23 nt, Artificial Sequence
  Description of Artificial Sequence: Synthetic oligonucleotide
augacguugcccaaacacauuuu

SEQ ID NO: 114 - RNA, 23 nt, Artificial Sequence
  Description of Artificial Sequence: Synthetic oligonucleotide
uaagggguguccacagucacaaa

SEQ ID NO: 115 - RNA, 23 nt, Artificial Sequence
  Description of Artificial Sequence: Synthetic oligonucleotide
aauaguagcuggcaccccaucca

SEQ ID NO: 116 - RNA, 23 nt, Artificial Sequence
  Description of Artificial Sequence: Synthetic oligonucleotide
acguugcccaaacacauuuucaa

SEQ ID NO: 117 - RNA, 23 nt, Artificial Sequence
  Description of Artificial Sequence: Synthetic oligonucleotide
ugucagaucuuggaaacagccaa

SEQ ID NO: 118 - RNA, 23 nt, Artificial Sequence
  Description of Artificial Sequence: Synthetic oligonucleotide
agggguggcuauuuuguuggaaa

SEQ ID NO: 119 - RNA, 23 nt, Artificial Sequence
  Description of Artificial Sequence: Synthetic oligonucleotide
aaggaaaucuaaacagaagacag

SEQ ID NO: 120 - RNA, 23 nt, Artificial Sequence
  Description of Artificial Sequence: Synthetic oligonucleotide
agacuucuaccuucccuuccaca

SEQ ID NO: 121 - RNA, 23 nt, Artificial Sequence
  Description of Artificial Sequence: Synthetic oligonucleotide
aucuuggaaacagccaaaggauu

SEQ ID NO: 122 - RNA, 23 nt, Artificial Sequence
  Description of Artificial Sequence: Synthetic oligonucleotide
uaucaucccagcugagagauggg

SEQ ID NO: 123 - RNA, 23 nt, Artificial Sequence
  Description of Artificial Sequence: Synthetic oligonucleotide
aucaauaguagcuggcaccccau

SEQ ID NO: 124 - RNA, 23 nt, Artificial Sequence
  Description of Artificial Sequence: Synthetic oligonucleotide
uaugacguugcccaaacacauuu

SEQ ID NO: 125 - RNA, 23 nt, Artificial Sequence
  Description of Artificial Sequence: Synthetic oligonucleotide
uucuuaaggaaaucuaaacagaa

SEQ ID NO: 126 - RNA, 23 nt, Artificial Sequence
  Description of Artificial Sequence: Synthetic oligonucleotide
uaugcaaguccauuucuuucuag

SEQ ID NO: 127 - RNA, 23 nt, Artificial Sequence
  Description of Artificial Sequence: Synthetic oligonucleotide
uuuaauauauuuccaggaugcaa

SEQ ID NO: 128 - RNA, 23 nt, Artificial Sequence
  Description of Artificial Sequence: Synthetic oligonucleotide
uaguucccauggucugacaggcu

SEQ ID NO: 129 - RNA, 23 nt, Artificial Sequence
  Description of Artificial Sequence: Synthetic oligonucleotide
uaucccauccacaccauguuuaa

SEQ ID NO: 130 - RNA, 23 nt, Artificial Sequence
  Description of Artificial Sequence: Synthetic oligonucleotide
uucaaaauuuuucauccugaguu

SEQ ID NO: 131 - RNA, 23 nt, Artificial Sequence
  Description of Artificial Sequence: Synthetic oligonucleotide
uuugucaaguaauacaugcugaa

SEQ ID NO: 132 - RNA, 23 nt, Artificial Sequence
  Description of Artificial Sequence: Synthetic oligonucleotide
ugauuuagcauguuguucauaau

SEQ ID NO: 133 - RNA, 23 nt, Artificial Sequence
  Description of Artificial Sequence: Synthetic oligonucleotide
uccuaaaacauuuggauauauuc

SEQ ID NO: 134 - RNA, 23 nt, Artificial Sequence
  Description of Artificial Sequence: Synthetic oligonucleotide
uuggauacagcuuccaucuggaa

SEQ ID NO: 135 - RNA, 23 nt, Artificial Sequence
  Description of Artificial Sequence: Synthetic oligonucleotide
uauauuuccaggaugaaagucca

SEQ ID NO: 136 - RNA, 23 nt, Artificial Sequence
  Description of Artificial Sequence: Synthetic oligonucleotide
auugauacaaauuagccggggga

SEQ ID NO: 137 - RNA, 23 nt, Artificial Sequence
  Description of Artificial Sequence: Synthetic oligonucleotide
ucccauucaagccauguuuaaca

SEQ ID NO: 138 - RNA, 23 nt, Artificial Sequence
  Description of Artificial Sequence: Synthetic oligonucleotide
augacguugucuaaacacauuuu

SEQ ID NO: 139 - RNA, 23 nt, Artificial Sequence
  Description of Artificial Sequence: Synthetic oligonucleotide
aaccggaauucuuccuuuaguau

SEQ ID NO: 140 - RNA, 23 nt, Artificial Sequence
  Description of Artificial Sequence: Synthetic oligonucleotide
auccuaaaacauuuggauauauu

SEQ ID NO: 141 - RNA, 23 nt, Artificial Sequence
  Description of Artificial Sequence: Synthetic oligonucleotide
aacaucagugccuuuccgcacac

SEQ ID NO: 142 - RNA, 23 nt, Artificial Sequence
  Description of Artificial Sequence: Synthetic oligonucleotide
aauuuaagaaccacuguuuuaaa

SEQ ID NO: 143 - RNA, 23 nt, Artificial Sequence
  Description of Artificial Sequence: Synthetic oligonucleotide
acugguuucaaaauuuuucaucc

SEQ ID NO: 144 - RNA, 23 nt, Artificial Sequence
  Description of Artificial Sequence: Synthetic oligonucleotide
aaaagggauugcuauuuuguugg

SEQ ID NO: 145 - RNA, 23 nt, Artificial Sequence
  Description of Artificial Sequence: Synthetic oligonucleotide
aagucgacagaucuguuucagca

SEQ ID NO: 146 - RNA, 23 nt, Artificial Sequence
  Description of Artificial Sequence: Synthetic oligonucleotide
ucaaaaugcccuuugcaacaauu

SEQ ID NO: 147 - RNA, 23 nt, Artificial Sequence
  Description of Artificial Sequence: Synthetic oligonucleotide
uacagguuaauaaacaaugagau

SEQ ID NO: 148 - RNA, 23 nt, Artificial Sequence
  Description of Artificial Sequence: Synthetic oligonucleotide
aaagggauugcuauuuuguugga

SEQ ID NO: 149 - RNA, 23 nt, Artificial Sequence
  Description of Artificial Sequence: Synthetic oligonucleotide
aauacagguuaauaaacaaugag

SEQ ID NO: 150 - RNA, 23 nt, Artificial Sequence
  Description of Artificial Sequence: Synthetic oligonucleotide
uugauaucuucccagcugauaga

SEQ ID NO: 151 - RNA, 23 nt, Artificial Sequence
  Description of Artificial Sequence: Synthetic oligonucleotide
uucuaaaagguuccuaggacacc

SEQ ID NO: 152 - RNA, 23 nt, Artificial Sequence
  Description of Artificial Sequence: Synthetic oligonucleotide
agggauugcuauuuuguuggaaa

SEQ ID NO: 153 - RNA, 23 nt, Artificial Sequence
  Description of Artificial Sequence: Synthetic oligonucleotide
aucagugccuuuccgcacacccc

SEQ ID NO: 154 - RNA, 23 nt, Artificial Sequence
  Description of Artificial Sequence: Synthetic oligonucleotide
augauaaaguacugguuucaaaa

SEQ ID NO: 155 - RNA, 23 nt, Artificial Sequence
  Description of Artificial Sequence: Synthetic oligonucleotide
uauauauagacuuuggaaguacu

SEQ ID NO: 156 - RNA, 23 nt, Artificial Sequence
  Description of Artificial Sequence: Synthetic oligonucleotide
auuucuaaaagguuccuaggaca

SEQ ID NO: 157 - RNA, 23 nt, Artificial Sequence
  Description of Artificial Sequence: Synthetic oligonucleotide
uuccaaaauuuuccucaggagaa

SEQ ID NO: 158 - RNA, 23 nt, Artificial Sequence
  Description of Artificial Sequence: Synthetic oligonucleotide
auuucagcaacauuccggagcau

SEQ ID NO: 159 - RNA, 23 nt, Artificial Sequence
  Description of Artificial Sequence: Synthetic oligonucleotide
uauuggucuccccacaaacacag

SEQ ID NO: 160 - RNA, 21 nt, Artificial Sequence
  Description of Artificial Sequence: Synthetic oligonucleotide
gaaugugaaagucaucgacaa

SEQ ID NO: 161 - RNA, 21 nt, Artificial Sequence
  Description of Artificial Sequence: Synthetic oligonucleotide
gaaugugaaagucaucgacaa

SEQ ID NO: 162 - RNA, 21 nt, Artificial Sequence
  Description of Artificial Sequence: Synthetic oligonucleotide
gaaugugaaagucaucgacaa

SEQ ID NO: 163 - RNA, 21 nt, Artificial Sequence
  Description of Artificial Sequence: Synthetic oligonucleotide
gaaugugaaagucaucgacaa

SEQ ID NO: 164 - RNA, 21 nt, Artificial Sequence
  Description of Artificial Sequence: Synthetic oligonucleotide
gaaugugaaagucaucgacaa

SEQ ID NO: 165 - RNA, 21 nt, Artificial Sequence
  Description of Artificial Sequence: Synthetic oligonucleotide
gaaugugaaagucaucgacaa

SEQ ID NO: 166 - RNA, 21 nt, Artificial Sequence
  Description of Artificial Sequence: Synthetic oligonucleotide
gaaugugaaagucaucgacaa

SEQ ID NO: 167 - RNA, 21 nt, Artificial Sequence
  Description of Artificial Sequence: Synthetic oligonucleotide
gaaugugaaagucaucgacaa

SEQ ID NO: 168 - RNA, 19 nt, Artificial Sequence
  Description of Artificial Sequence: Synthetic oligonucleotide
augugaaagucaucgacaa

SEQ ID NO: 169 - RNA, 19 nt, Artificial Sequence
  Description of Artificial Sequence: Synthetic oligonucleotide
augugaaagucaucgacaa

SEQ ID NO: 170 - RNA, 21 nt, Artificial Sequence
  Description of Artificial Sequence: Synthetic oligonucleotide
gaaugugaaagucaucgacaa

SEQ ID NO: 171 - RNA, 21 nt, Artificial Sequence
  Description of Artificial Sequence: Synthetic oligonucleotide
gaaugugaaagucaucgacaa

SEQ ID NO: 172 - RNA, 21 nt, Artificial Sequence
  Description of Artificial Sequence: Synthetic oligonucleotide
gaaugugaaagucaucgacaa

SEQ ID NO: 173 - RNA, 21 nt, Artificial Sequence
  Description of Artificial Sequence: Synthetic oligonucleotide
gaaugugaaagucaucgacaa

SEQ ID NO: 174 - RNA, 21 nt, Artificial Sequence
  Description of Artificial Sequence: Synthetic oligonucleotide
gaaugugaaagucaucgacaa

SEQ ID NO: 175 - RNA, 21 nt, Artificial Sequence
  Description of Artificial Sequence: Synthetic oligonucleotide
gaaugugaaagucaucgacaa

SEQ ID NO: 176 - RNA, 21 nt, Artificial Sequence
  Description of Artificial Sequence: Synthetic oligonucleotide
gaaugugaaagucaucgacaa

SEQ ID NO: 177 - RNA, 21 nt, Artificial Sequence
  Description of Artificial Sequence: Synthetic oligonucleotide
gaaugugaaagucaucgacaa

SEQ ID NO: 178 - RNA, 21 nt, Artificial Sequence
  Description of Artificial Sequence: Synthetic oligonucleotide
gaaugugaaagucaucgacaa

SEQ ID NO: 179 - RNA, 21 nt, Artificial Sequence
  Description of Artificial Sequence: Synthetic oligonucleotide
gaaugugaaagucaucgacaa

SEQ ID NO: 180 - RNA, 21 nt, Artificial Sequence
  Description of Artificial Sequence: Synthetic oligonucleotide
gaaugugaaagucaucgacaa

SEQ ID NO: 181 - DNA, 21 bp, Artificial Sequence
  Description of Artificial Sequence: Synthetic oligonucleotide
  Description of Combined DNA/RNA Molecule: Synthetic oligonucleotide
gaaugtgaaagucaucgacaa

SEQ ID NO: 182 - RNA, 21 nt, Artificial Sequence
  Description of Artificial Sequence: Synthetic oligonucleotide
gaaugugaaagucaucgacaa

SEQ ID NO: 183 - DNA, 21 bp, Artificial Sequence
  Description of Artificial Sequence: Synthetic oligonucleotide
  Description of Combined DNA/RNA Molecule: Synthetic oligonucleotide
gaaugtgaaagucaucgacaa

SEQ ID NO: 184 - RNA, 21 nt, Artificial Sequence
  Description of Artificial Sequence: Synthetic oligonucleotide
gaaugugaaagucaucgacaa

SEQ ID NO: 185 - RNA, 21 nt, Artificial Sequence
  Description of Artificial Sequence: Synthetic oligonucleotide
gaaugugaaagucaucgacaa

SEQ ID NO: 186 - DNA, 21 bp, Artificial Sequence
  Description of Artificial Sequence: Synthetic oligonucleotide
  Description of Combined DNA/RNA Molecule: Synthetic oligonucleotide
gaaugugaaagucauctacaa

SEQ ID NO: 187 - RNA, 21 nt, Artificial Sequence
  Description of Artificial Sequence: Synthetic oligonucleotide
  modified_base (17)..(17): Abasic 2'-OMe Y34 nucleotide
gaaugugaaagucaucnacaa

SEQ ID NO: 188 - DNA, 21 bp, Artificial Sequence
  Description of Artificial Sequence: Synthetic oligonucleotide
  Description of Combined DNA/RNA Molecule: Synthetic oligonucleotide
gaaugugaaagucatctacaa

SEQ ID NO: 189 - RNA, 21 nt, Artificial Sequence
  Description of Artificial Sequence: Synthetic oligonucleotide
gaaugugaaagucaucgacaa

SEQ ID NO: 190 - DNA, 21 bp, Artificial Sequence
  Description of Artificial Sequence: Synthetic oligonucleotide
  Description of Combined DNA/RNA Molecule: Synthetic oligonucleotide
gaaugugaaagucauctacaa

SEQ ID NO: 191 - RNA, 21 nt, Artificial Sequence
  Description of Artificial Sequence: Synthetic oligonucleotide
  modified_base (17)..(17): Abasic 2'-OMe Y34 nucleotide
gaaugugaaagucaucnacaa

SEQ ID NO: 192 - RNA, 21 nt, Artificial Sequence
  Description of Artificial Sequence: Synthetic oligonucleotide
gaaugugaaagucaucgacaa

SEQ ID NO: 193 - RNA, 21 nt, Artificial Sequence
  Description of Artificial Sequence: Synthetic oligonucleotide
gaaugugaaagucaucgacaa

SEQ ID NO: 194 - RNA, 21 nt, Artificial Sequence
  Description of Artificial Sequence: Synthetic oligonucleotide
gaaugugaaagucaucgacaa

SEQ ID NO: 195 - RNA, 21 nt, Artificial Sequence
  Description of Artificial Sequence: Synthetic oligonucleotide
gaaugugaaagucaucgacaa

SEQ ID NO: 196 - RNA, 21 nt, Artificial Sequence
  Description of Artificial Sequence: Synthetic oligonucleotide
gaaugugaaagucaucgacaa

SEQ ID NO: 197 - RNA, 21 nt, Artificial Sequence
  Description of Artificial Sequence: Synthetic oligonucleotide
gaaugugaaagucaucgacaa

SEQ ID NO: 198 - RNA, 21 nt, Artificial Sequence
  Description of Artificial Sequence: Synthetic oligonucleotide
gaaugugaaagucaucgacaa

SEQ ID NO: 199 - RNA, 21 nt, Artificial Sequence
  Description of Artificial Sequence: Synthetic oligonucleotide
gacuuucauccuggaaauaua

SEQ ID NO: 200 - RNA, 21 nt, Artificial Sequence
  Description of Artificial Sequence: Synthetic oligonucleotide
gacuuucauccuggaaauaua

SEQ ID NO: 201 - RNA, 21 nt, Artificial Sequence
  Description of Artificial Sequence: Synthetic oligonucleotide
gacuuucauccuggaaauaua

SEQ ID NO: 202 - RNA, 21 nt, Artificial Sequence
  Description of Artificial Sequence: Synthetic oligonucleotide
gacuuucauccuggaaauaua

SEQ ID NO: 203 - RNA, 21 nt, Artificial Sequence
  Description of Artificial Sequence: Synthetic oligonucleotide
gacuuucauccuggaaauaua

SEQ ID NO: 204 - RNA, 21 nt, Artificial Sequence
  Description of Artificial Sequence: Synthetic oligonucleotide
gacuuucauccuggaaauaua

SEQ ID NO: 205 - RNA, 19 nt, Artificial Sequence
  Description of Artificial Sequence: Synthetic oligonucleotide
cuuucauccuggaaauaua

SEQ ID NO: 206 - RNA, 19 nt, Artificial Sequence
  Description of Artificial Sequence: Synthetic oligonucleotide
cuuucauccuggaaauaua

SEQ ID NO: 207 - RNA, 21 nt, Artificial Sequence
  Description of Artificial Sequence: Synthetic oligonucleotide
gacuuucauccuggaaauaua

SEQ ID NO: 208 - RNA, 21 nt, Artificial Sequence
  Description of Artificial Sequence: Synthetic oligonucleotide
gacuuucauccuggaaauaua

SEQ ID NO: 209 - RNA, 21 nt, Artificial Sequence
  Description of Artificial Sequence: Synthetic oligonucleotide
gacuuucauccuggaaauaua

SEQ ID NO: 210 - RNA, 21 nt, Artificial Sequence
  Description of Artificial Sequence: Synthetic oligonucleotide
gacuuucauccuggaaauaua

SEQ ID NO: 211 - RNA, 21 nt, Artificial Sequence
  Description of Artificial Sequence: Synthetic oligonucleotide
gacuuucauccuggaaauaua

SEQ ID NO: 212 - RNA, 21 nt, Artificial Sequence
  Description of Artificial Sequence: Synthetic oligonucleotide
gacuuucauccuggaaauaua

SEQ ID NO: 213 - RNA, 21 nt, Artificial Sequence
  Description of Artificial Sequence: Synthetic oligonucleotide
gacuuucauccuggaaauaua

SEQ ID NO: 214 - RNA, 21 nt, Artificial Sequence
  Description of Artificial Sequence: Synthetic oligonucleotide
gacuuucauccuggaaauaua

SEQ ID NO: 215 - RNA, 21 nt, Artificial Sequence
  Description of Artificial Sequence: Synthetic oligonucleotide
gacuuucauccuggaaauaua

SEQ ID NO: 216 - RNA, 21 nt, Artificial Sequence
  Description of Artificial Sequence: Synthetic oligonucleotide
gacuuucauccuggaaauaua

SEQ ID NO: 217 - RNA, 21 nt, Artificial Sequence
  Description of Artificial Sequence: Synthetic oligonucleotide
gacuuucauccuggaaauaua

SEQ ID NO: 218 - RNA, 21 nt, Artificial Sequence
  Description of Artificial Sequence: Synthetic oligonucleotide
gacuuucauccuggaaauaua

SEQ ID NO: 219 - RNA, 21 nt, Artificial Sequence
  Description of Artificial Sequence: Synthetic oligonucleotide
gacuuucauccuggaaauaua

SEQ ID NO: 220 - DNA, 21 bp, Artificial Sequence
  Description of Artificial Sequence: Synthetic oligonucleotide
  Description of Combined DNA/RNA Molecule: Synthetic oligonucleotide
gacutucauccuggaaauaua

SEQ ID NO: 221 - DNA, 21 bp, Artificial Sequence
  Description of Artificial Sequence: Synthetic oligonucleotide
  Description of Combined DNA/RNA Molecule: Synthetic oligonucleotide
gacuutcauccuggaaauaua

SEQ ID NO: 222 - RNA, 21 nt, Artificial Sequence
  Description of Artificial Sequence: Synthetic oligonucleotide
gacuuucauccuggaaauaua

SEQ ID NO: 223 - RNA, 21 nt, Artificial Sequence
  Description of Artificial Sequence: Synthetic oligonucleotide
gacuuucauccuggaaauaua

SEQ ID NO: 224 - DNA, 21 bp, Artificial Sequence
  Description of Artificial Sequence: Synthetic oligonucleotide
  Description of Combined DNA/RNA Molecule: Synthetic oligonucleotide
gacuuucauccuggaatuaua

SEQ ID NO: 225 - RNA, 21 nt, Artificial Sequence
  Description of Artificial Sequence: Synthetic oligonucleotide
  modified_base (17)..(17): Abasic 2'-OMe Y34 nucleotide
gacuuucauccuggaanuaua

SEQ ID NO: 226 - DNA, 21 bp, Artificial Sequence
  Description of Artificial Sequence: Synthetic oligonucleotide
  Description of Combined DNA/RNA Molecule: Synthetic oligonucleotide
gacuuucauccuggaatuaua

SEQ ID NO: 227 - DNA, 21 bp, Artificial Sequence
  Description of Artificial Sequence: Synthetic oligonucleotide
  Description of Combined DNA/RNA Molecule: Synthetic oligonucleotide
gacuuucauccuggaatuaua

SEQ ID NO: 228 - RNA, 21 nt, Artificial Sequence
  Description of Artificial Sequence: Synthetic oligonucleotide
gacuuucauccuggaaauaua

SEQ ID NO: 229 - DNA, 21 bp, Artificial Sequence
  Description of Artificial Sequence: Synthetic oligonucleotide
  Description of Combined DNA/RNA Molecule: Synthetic oligonucleotide
gacuutcauccuggaaauaua

SEQ ID NO: 230 - RNA, 21 nt, Artificial Sequence
  Description of Artificial Sequence: Synthetic oligonucleotide
gacuuucauccuggaaauaua

SEQ ID NO: 231 - RNA, 21 nt, Artificial Sequence
  Description of Artificial Sequence: Synthetic oligonucleotide
gacuuucauccuggaaauaua

SEQ ID NO: 232 - RNA, 21 nt, Artificial Sequence
  Description of Artificial Sequence: Synthetic oligonucleotide
gacuuucauccuggaaauaua

SEQ ID NO: 233 - RNA, 21 nt, Artificial Sequence
  Description of Artificial Sequence: Synthetic oligonucleotide
gacuuucauccuggaaauaua

SEQ ID NO: 234 - RNA, 21 nt, Artificial Sequence
  Description of Artificial Sequence: Synthetic oligonucleotide
gacuuucauccuggaaauaua

SEQ ID NO: 235 - RNA, 21 nt, Artificial Sequence
  Description of Artificial Sequence: Synthetic oligonucleotide
gacuuucauccuggaaauaua

SEQ ID NO: 236 - RNA, 21 nt, Artificial Sequence
  Description of Artificial Sequence: Synthetic oligonucleotide
gacuuucauccuggaaauaua

SEQ ID NO: 237 - RNA, 21 nt, Artificial Sequence
  Description of Artificial Sequence: Synthetic oligonucleotide
gacuuucauccuggaaauaua

SEQ ID NO: 238 - RNA, 21 nt, Artificial Sequence
  Description of Artificial Sequence: Synthetic oligonucleotide
agaaagguguucaagauguca

SEQ ID NO: 239 - RNA, 21 nt, Artificial Sequence
  Description of Artificial Sequence: Synthetic oligonucleotide
cauccuggaaauauauuaacu

SEQ ID NO: 240 - RNA, 21 nt, Artificial Sequence
  Description of Artificial Sequence: Synthetic oligonucleotide
gaaugugaaagucaucgacaa

SEQ ID NO: 241 - RNA, 21 nt, Artificial Sequence
  Description of Artificial Sequence: Synthetic oligonucleotide
agugcacaauauuuucccaua

SEQ ID NO: 242 - RNA, 21 nt, Artificial Sequence
  Description of Artificial Sequence: Synthetic oligonucleotide
gaaagucaucgacaagacauu

SEQ ID NO: 243 - RNA, 21 nt, Artificial Sequence
  Description of Artificial Sequence: Synthetic oligonucleotide
aaugugaaagucaucgacaaa

SEQ ID NO: 244 - RNA, 21 nt, Artificial Sequence
  Description of Artificial Sequence: Synthetic oligonucleotide
cuggaaauauauuaacuguua

SEQ ID NO: 245 - RNA, 21 nt, Artificial Sequence
  Description of Artificial Sequence: Synthetic oligonucleotide
auuuucccaucuguauuauuu

SEQ ID NO: 246 - RNA, 21 nt, Artificial Sequence
  Description of Artificial Sequence: Synthetic oligonucleotide
ugucguucuuuuccaacaaaa

SEQ ID NO: 247 - RNA, 21 nt, Artificial Sequence
  Description of Artificial Sequence: Synthetic oligonucleotide
auccuggaaauauauuaacua

SEQ ID NO: 248 - RNA, 21 nt, Artificial Sequence
  Description of Artificial Sequence: Synthetic oligonucleotide
gcauuuugagaggugaugaua

SEQ ID NO: 249 - RNA, 21 nt, Artificial Sequence
  Description of Artificial Sequence: Synthetic oligonucleotide
cagggggagaaagguguucaa

SEQ ID NO: 250 - RNA, 21 nt, Artificial Sequence
  Description of Artificial Sequence: Synthetic oligonucleotide
ggaaauauauuaacuguuaaa

SEQ ID NO: 251 - RNA, 21 nt, Artificial Sequence
  Description of Artificial Sequence: Synthetic oligonucleotide
cauuggugaggaaaaauccuu

SEQ ID NO: 252 - RNA, 21 nt, Artificial Sequence
  Description of Artificial Sequence: Synthetic oligonucleotide
gggagaaagguguucaagaua

SEQ ID NO: 253 - RNA, 21 nt, Artificial Sequence
  Description of Artificial Sequence: Synthetic oligonucleotide
ggcauuuugagaggugaugau

SEQ ID NO: 254 - RNA, 21 nt, Artificial Sequence
  Description of Artificial Sequence: Synthetic oligonucleotide
uacaaagggugucguucuuuu

SEQ ID NO: 255 - RNA, 21 nt, Artificial Sequence
  Description of Artificial Sequence: Synthetic oligonucleotide
ugggaucuuggugucgaauca

SEQ ID NO: 256 - RNA, 21 nt, Artificial Sequence
  Description of Artificial Sequence: Synthetic oligonucleotide
cugacagugcacaauauuuua

SEQ ID NO: 257 - RNA, 21 nt, Artificial Sequence
  Description of Artificial Sequence: Synthetic oligonucleotide
cagugcacaauauuuucccau

SEQ ID NO: 258 - RNA, 21 nt, Artificial Sequence
  Description of Artificial Sequence: Synthetic oligonucleotide
acuuuucaauggguguccuaa

SEQ ID NO: 259 - RNA, 21 nt, Artificial Sequence
  Description of Artificial Sequence: Synthetic oligonucleotide
acauuggugaggaaaaauccu

SEQ ID NO: 260 - RNA, 21 nt, Artificial Sequence
  Description of Artificial Sequence: Synthetic oligonucleotide
uugcuuuugacuuuucaauga

SEQ ID NO: 261 - RNA, 21 nt, Artificial Sequence
  Description of Artificial Sequence: Synthetic oligonucleotide
cauuuugagaggugaugauga

SEQ ID NO: 262 - RNA, 21 nt, Artificial Sequence
  Description of Artificial Sequence: Synthetic oligonucleotide
uugacuuuucaauggguguca

SEQ ID NO: 263 - RNA, 21 nt, Artificial Sequence
  Description of Artificial Sequence: Synthetic oligonucleotide
cgacuucuguuuuaggacaga

SEQ ID NO: 264 - RNA, 21 nt, Artificial Sequence
  Description of Artificial Sequence: Synthetic oligonucleotide
cucugagugggugccagaaua

SEQ ID NO: 265 - RNA, 21 nt, Artificial Sequence
  Description of Artificial Sequence: Synthetic oligonucleotide
gggugccagaaugugaaagua

SEQ ID NO: 266 - RNA, 21 nt, Artificial Sequence
  Description of Artificial Sequence: Synthetic oligonucleotide
ucaauggguguccuaggaaca

SEQ ID NO: 267 - RNA, 21 nt, Artificial Sequence
  Description of Artificial Sequence: Synthetic oligonucleotide
aaagucaucgacaagacauua

SEQ ID NO: 268 - RNA, 21 nt, Artificial Sequence
  Description of Artificial Sequence: Synthetic oligonucleotide
auuuugagaggugaugaugca

SEQ ID NO: 269 - RNA, 21 nt, Artificial Sequence
  Description of Artificial Sequence: Synthetic oligonucleotide
aucgacaagacauuggugaga

SEQ ID NO: 270 - RNA, 21 nt, Artificial Sequence
  Description of Artificial Sequence: Synthetic oligonucleotide
ggugccagaaugugaaaguca

SEQ ID NO: 271 - RNA, 21 nt, Artificial Sequence
  Description of Artificial Sequence: Synthetic oligonucleotide
gacagugcacaauauuuucca

SEQ ID NO: 272 - RNA, 21 nt, Artificial Sequence
  Description of Artificial Sequence: Synthetic oligonucleotide
acaaagagacacugugcagaa

SEQ ID NO: 273 - RNA, 21 nt, Artificial Sequence
  Description of Artificial Sequence: Synthetic oligonucleotide
uuuucaauggguguccuagga

SEQ ID NO: 274 - RNA, 21 nt, Artificial Sequence
  Description of Artificial Sequence: Synthetic oligonucleotide
ccguuuccaagaucugacagu

SEQ ID NO: 275 - RNA, 21 nt, Artificial Sequence
  Description of Artificial Sequence: Synthetic oligonucleotide
agggggagaaagguguucaaa

SEQ ID NO: 276 - RNA, 21 nt, Artificial Sequence
  Description of Artificial Sequence: Synthetic oligonucleotide
agucaucgacaagacauuggu

SEQ ID NO: 277 - RNA, 23 nt, Artificial Sequence
  Description of Artificial Sequence: Synthetic oligonucleotide
uugucgaugacuuucacauucug

SEQ ID NO: 278 - RNA, 23 nt, Artificial Sequence
  Description of Artificial Sequence: Synthetic oligonucleotide
uugucgaugacuuucacauucug

SEQ ID NO: 279 - RNA, 23 nt, Artificial Sequence
  Description of Artificial Sequence: Synthetic oligonucleotide
uugucgaugacuuucacauucug

SEQ ID NO: 280 - RNA, 23 nt, Artificial Sequence
  Description of Artificial Sequence: Synthetic oligonucleotide
uugucgaugacuuucacauucug

SEQ ID NO: 281 - RNA, 23 nt, Artificial Sequence
  Description of Artificial Sequence: Synthetic oligonucleotide
uugucgaugacuuucacauucug

SEQ ID NO: 282 - RNA, 23 nt, Artificial Sequence
  Description of Artificial Sequence: Synthetic oligonucleotide
uugucgaugacuuucacauucug

SEQ ID NO: 283 - RNA, 23 nt, Artificial Sequence
  Description of Artificial Sequence: Synthetic oligonucleotide
uugucgaugacuuucacauucug

SEQ ID NO: 284 - RNA, 23 nt, Artificial Sequence
  Description of Artificial Sequence: Synthetic oligonucleotide
uugucgaugacuuucacauucug

SEQ ID NO: 285 - RNA, 21 nt, Artificial Sequence
  Description of Artificial Sequence: Synthetic oligonucleotide
uugucgaugacuuucacauuc

SEQ ID NO: 286 - RNA, 21 nt, Artificial Sequence
  Description of Artificial Sequence: Synthetic oligonucleotide
uugucgaugacuuucacauuc

SEQ ID NO: 287 - RNA, 23 nt, Artificial Sequence
  Description of Artificial Sequence: Synthetic oligonucleotide
uugucgaugacuuucacauucug

SEQ ID NO: 288 - RNA, 23 nt, Artificial Sequence
  Description of Artificial Sequence: Synthetic oligonucleotide
uugucgaugacuuucacauucug

SEQ ID NO: 289 - RNA, 23 nt, Artificial Sequence
  Description of Artificial Sequence: Synthetic oligonucleotide
uugucgaugacuuucacauucug

SEQ ID NO: 290 - RNA, 23 nt, Artificial Sequence
  Description of Artificial Sequence: Synthetic oligonucleotide
uugucgaugacuuucacauucug

SEQ ID NO: 291 - RNA, 23 nt, Artificial Sequence
  Description of Artificial Sequence: Synthetic oligonucleotide
uugucgaugacuuucacauucug

SEQ ID NO: 292 - RNA, 23 nt, Artificial Sequence
  Description of Artificial Sequence: Synthetic oligonucleotide
uugucgaugacuuucacauucug

SEQ ID NO: 293 - RNA, 23 nt, Artificial Sequence
  Description of Artificial Sequence: Synthetic oligonucleotide
uugucgaugacuuucacauucug

SEQ ID NO: 294 - RNA, 23 nt, Artificial Sequence
  Description of Artificial Sequence: Synthetic oligonucleotide
uugucgaugacuuucacauucug

SEQ ID NO: 295 - RNA, 23 nt, Artificial Sequence
  Description of Artificial Sequence: Synthetic oligonucleotide
uugucgaugacuuucacauucug

SEQ ID NO: 296 - RNA, 23 nt, Artificial Sequence
  Description of Artificial Sequence: Synthetic oligonucleotide
uugucgaugacuuucacauucug

SEQ ID NO: 297 - RNA, 23 nt, Artificial Sequence
  Description of Artificial Sequence: Synthetic oligonucleotide
uugucgaugacuuucacauucug

SEQ ID NO: 298 - RNA, 23 nt, Artificial Sequence
  Description of Artificial Sequence: Synthetic oligonucleotide
uugucgaugacuuucacauucug

SEQ ID NO: 299 - RNA, 23 nt, Artificial Sequence
  Description of Artificial Sequence: Synthetic oligonucleotide
uugucgaugacuuucacauucug

SEQ ID NO: 300 - RNA, 23 nt, Artificial Sequence
  Description of Artificial Sequence: Synthetic oligonucleotide
uugucgaugacuuucacauucug

SEQ ID NO: 301 - RNA, 23 nt, Artificial Sequence
  Description of Artificial Sequence: Synthetic oligonucleotide
uugucgaugacuuucacauucug

SEQ ID NO: 302 - RNA, 23 nt, Artificial Sequence
  Description of Artificial Sequence: Synthetic oligonucleotide
uugucgaugacuuucacauucug

SEQ ID NO: 303 - RNA, 23 nt, Artificial Sequence
  Description of Artificial Sequence: Synthetic oligonucleotide
uugucgaugacuuucacauucug

SEQ ID NO: 304 - RNA, 23 nt, Artificial Sequence
  Description of Artificial Sequence: Synthetic oligonucleotide
uugucgaugacuuucacauucug

SEQ ID NO: 305 - RNA, 23 nt, Artificial Sequence
  Description of Artificial Sequence: Synthetic oligonucleotide
uugucgaugacuuucacauucug

SEQ ID NO: 306 - RNA, 23 nt, Artificial Sequence
  Description of Artificial Sequence: Synthetic oligonucleotide
uugucgaugacuuucacauucug

SEQ ID NO: 307 - RNA, 23 nt, Artificial Sequence
  Description of Artificial Sequence: Synthetic oligonucleotide
uugucgaugacuuucacauucug

SEQ ID NO: 308 - RNA, 23 nt, Artificial Sequence
  Description of Artificial Sequence: Synthetic oligonucleotide
uugucgaugacuuucacauucug

SEQ ID NO: 309 - DNA, 23 bp, Artificial Sequence
  Description of Artificial Sequence: Synthetic oligonucleotide
  Description of Combined DNA/RNA Molecule: Synthetic oligonucleotide
utgucgaugacuutcacauucug

SEQ ID NO: 310 - DNA, 23 bp, Artificial Sequence
  Description of Artificial Sequence: Synthetic oligonucleotide
  Description of Combined DNA/RNA Molecule: Synthetic oligonucleotide
uugucgaugacuutcacauucug

SEQ ID NO: 311 - DNA, 23 bp, Artificial Sequence
  Description of Artificial Sequence: Synthetic oligonucleotide
  Description of Combined DNA/RNA Molecule: Synthetic oligonucleotide
utgucgaugacuutcacauucug

SEQ ID NO: 312 - DNA, 23 bp, Artificial Sequence
  Description of Artificial Sequence: Synthetic oligonucleotide
  Description of Combined DNA/RNA Molecule: Synthetic oligonucleotide
uugucgaugacuutcacauucug

SEQ ID NO: 313 - DNA, 23 bp, Artificial Sequence
  Description of Artificial Sequence: Synthetic oligonucleotide
  Description of Combined DNA/RNA Molecule: Synthetic oligonucleotide
utgucgaugacuutcacauucug

SEQ ID NO: 314 - DNA, 23 bp, Artificial Sequence
  Description of Artificial Sequence: Synthetic oligonucleotide
  Description of Combined DNA/RNA Molecule: Synthetic oligonucleotide
utgucgaugacuutcacauucug

SEQ ID NO: 315 - DNA, 23 bp, Artificial Sequence
  Description of Artificial Sequence: Synthetic oligonucleotide
  Description of Combined DNA/RNA Molecule: Synthetic oligonucleotide
utgucgaugacuutcacauucug

SEQ ID NO: 316 - RNA, 23 nt, Artificial Sequence
  Description of Artificial Sequence: Synthetic oligonucleotide
uauauuuccaggaugaaagucca

SEQ ID NO: 317 - RNA, 23 nt, Artificial Sequence
  Description of Artificial Sequence: Synthetic oligonucleotide
uauauuuccaggaugaaagucca

SEQ ID NO: 318 - RNA, 23 nt, Artificial Sequence
  Description of Artificial Sequence: Synthetic oligonucleotide
uauauuuccaggaugaaagucca

SEQ ID NO: 319 - RNA, 23 nt, Artificial Sequence
  Description of Artificial Sequence: Synthetic oligonucleotide
uauauuuccaggaugaaagucca

SEQ ID NO: 320 - RNA, 23 nt, Artificial Sequence
  Description of Artificial Sequence: Synthetic oligonucleotide
uauauuuccaggaugaaagucca

SEQ ID NO: 321 - RNA, 23 nt, Artificial Sequence
  Description of Artificial Sequence: Synthetic oligonucleotide
uauauuuccaggaugaaagucca

SEQ ID NO: 322 - RNA, 21 nt, Artificial Sequence
  Description of Artificial Sequence: Synthetic oligonucleotide
uauauuuccaggaugaaaguc

SEQ ID NO: 323 - RNA, 21 nt, Artificial Sequence
  Description of Artificial Sequence: Synthetic oligonucleotide
uauauuuccaggaugaaaguc

SEQ ID NO: 324 - RNA, 23 nt, Artificial Sequence
  Description of Artificial Sequence: Synthetic oligonucleotide
uauauuuccaggaugaaagucca

SEQ ID NO: 325 - RNA, 23 nt, Artificial Sequence
  Description of Artificial Sequence: Synthetic oligonucleotide
uauauuuccaggaugaaagucca

SEQ ID NO: 326 - RNA, 23 nt, Artificial Sequence
  Description of Artificial Sequence: Synthetic oligonucleotide
uauauuuccaggaugaaagucca

SEQ ID NO: 327 - RNA, 23 nt, Artificial Sequence
  Description of Artificial Sequence: Synthetic oligonucleotide
uauauuuccaggaugaaagucca

SEQ ID NO: 328 - RNA, 23 nt, Artificial Sequence
  Description of Artificial Sequence: Synthetic oligonucleotide
uauauuuccaggaugaaagucca

SEQ ID NO: 329 - RNA, 23 nt, Artificial Sequence
  Description of Artificial Sequence: Synthetic oligonucleotide
uauauuuccaggaugaaagucca

SEQ ID NO: 330 - RNA, 23 nt, Artificial Sequence
  Description of Artificial Sequence: Synthetic oligonucleotide
uauauuuccaggaugaaagucca

SEQ ID NO: 331 - RNA, 23 nt, Artificial Sequence
  Description of Artificial Sequence: Synthetic oligonucleotide
uauauuuccaggaugaaagucca

SEQ ID NO: 332 - RNA, 23 nt, Artificial Sequence
  Description of Artificial Sequence: Synthetic oligonucleotide
uauauuuccaggaugaaagucca

SEQ ID NO: 333 - RNA, 23 nt, Artificial Sequence
  Description of Artificial Sequence: Synthetic oligonucleotide
uauauuuccaggaugaaagucca

SEQ ID NO: 334 - RNA, 23 nt, Artificial Sequence
  Description of Artificial Sequence: Synthetic oligonucleotide
uauauuuccaggaugaaagucca

SEQ ID NO: 335 - RNA, 23 nt, Artificial Sequence
  Description of Artificial Sequence: Synthetic oligonucleotide
uauauuuccaggaugaaagucca

SEQ ID NO: 336 - RNA, 23 nt, Artificial Sequence
  Description of Artificial Sequence: Synthetic oligonucleotide
uauauuuccaggaugaaagucca

SEQ ID NO: 337 - RNA, 23 nt, Artificial Sequence
  Description of Artificial Sequence: Synthetic oligonucleotide
uauauuuccaggaugaaagucca

SEQ ID NO: 338 - RNA, 23 nt, Artificial Sequence
  Description of Artificial Sequence: Synthetic oligonucleotide
uauauuuccaggaugaaagucca

SEQ ID NO: 339 - RNA, 23 nt, Artificial Sequence
  Description of Artificial Sequence: Synthetic oligonucleotide
uauauuuccaggaugaaagucca

SEQ ID NO: 340 - RNA, 23 nt, Artificial Sequence
  Description of Artificial Sequence: Synthetic oligonucleotide
uauauuuccaggaugaaagucca

SEQ ID NO: 341 - RNA, 23 nt, Artificial Sequence
  Description of Artificial Sequence: Synthetic oligonucleotide
uauauuuccaggaugaaagucca

SEQ ID NO: 342 - RNA, 23 nt, Artificial Sequence
  Description of Artificial Sequence: Synthetic oligonucleotide
uauauuuccaggaugaaagucca

SEQ ID NO: 343 - RNA, 23 nt, Artificial Sequence
  Description of Artificial Sequence: Synthetic oligonucleotide
uauauuuccaggaugaaagucca

SEQ ID NO: 344 - RNA, 23 nt, Artificial Sequence
  Description of Artificial Sequence: Synthetic oligonucleotide
uauauuuccaggaugaaagucca

SEQ ID NO: 345 - RNA, 23 nt, Artificial Sequence
  Description of Artificial Sequence: Synthetic oligonucleotide
uauauuuccaggaugaaagucca

SEQ ID NO: 346 - RNA, 23 nt, Artificial Sequence
  Description of Artificial Sequence: Synthetic oligonucleotide
uauauuuccaggaugaaagucca

SEQ ID NO: 347 - DNA, 23 bp, Artificial Sequence
  Description of Artificial Sequence: Synthetic oligonucleotide
  Description of Combined DNA/RNA Molecule: Synthetic oligonucleotide
uauauuuccaggatgaaagucca

SEQ ID NO: 348 - DNA, 23 bp, Artificial Sequence
  Description of Artificial Sequence: Synthetic oligonucleotide
  Description of Combined DNA/RNA Molecule: Synthetic oligonucleotide
uauauuuccaggatgaaagucca

SEQ ID NO: 349 - DNA, 23 bp, Artificial Sequence
  Description of Artificial Sequence: Synthetic oligonucleotide
  Description of Combined DNA/RNA Molecule: Synthetic oligonucleotide
uauauuuccaggatgaaagucca

SEQ ID NO: 350 - DNA, 23 bp, Artificial Sequence
  Description of Artificial Sequence: Synthetic oligonucleotide
  Description of Combined DNA/RNA Molecule: Synthetic oligonucleotide
uauautuccaggatgaaagucca

SEQ ID NO: 351 - DNA, 23 bp, Artificial Sequence
  Description of Artificial Sequence: Synthetic oligonucleotide
  Description of Combined DNA/RNA Molecule: Synthetic oligonucleotide
uauautuccaggatgaaagucca

SEQ ID NO: 352 - DNA, 23 bp, Artificial Sequence
  Description of Artificial Sequence: Synthetic oligonucleotide
  Description of Combined DNA/RNA Molecule: Synthetic oligonucleotide
uauauuuccaggatgaaagucca

SEQ ID NO: 353 - DNA, 23 bp, Artificial Sequence
  Description of Artificial Sequence: Synthetic oligonucleotide
  Description of Combined DNA/RNA Molecule: Synthetic oligonucleotide
uauautuccaggatgaaagucca

SEQ ID NO: 354 - DNA, 23 bp, Artificial Sequence
  Description of Artificial Sequence: Synthetic oligonucleotide
  Description of Combined DNA/RNA Molecule: Synthetic oligonucleotide
uauauuuccaggatgaaagucca

SEQ ID NO: 355 - RNA, 23 nt, Artificial Sequence
  Description of Artificial Sequence: Synthetic oligonucleotide
ugacaucuugaacaccuuucucc

SEQ ID NO: 356 - RNA, 23 nt, Artificial Sequence
  Description of Artificial Sequence: Synthetic oligonucleotide
aguuaauauauuuccaggaugaa

SEQ ID NO: 357 - RNA, 23 nt, Artificial Sequence
  Description of Artificial Sequence: Synthetic oligonucleotide
uugucgaugacuuucacauucug

SEQ ID NO: 358 - RNA, 23 nt, Artificial Sequence
  Description of Artificial Sequence: Synthetic oligonucleotide
uaugggaaaauauugugcacugu

SEQ ID NO: 359 - RNA, 23 nt, Artificial Sequence
  Description of Artificial Sequence: Synthetic oligonucleotide
aaugucuugucgaugacuuucac

SEQ ID NO: 360 - RNA, 23 nt, Artificial Sequence
  Description of Artificial Sequence: Synthetic oligonucleotide
uuugucgaugacuuucacauucu

SEQ ID NO: 361 - RNA, 23 nt, Artificial Sequence
  Description of Artificial Sequence: Synthetic oligonucleotide
uaacaguuaauauauuuccagga

SEQ ID NO: 362 - RNA, 23 nt, Artificial Sequence
  Description of Artificial Sequence: Synthetic oligonucleotide
aaauaauacagaugggaaaauau

SEQ ID NO: 363 - RNA, 23 nt, Artificial Sequence
  Description of Artificial Sequence: Synthetic oligonucleotide
uuuuguuggaaaagaacgacacc

SEQ ID NO: 364 - RNA, 23 nt, Artificial Sequence
  Description of Artificial Sequence: Synthetic oligonucleotide
uaguuaauauauuuccaggauga

SEQ ID NO: 365 - RNA, 23 nt, Artificial Sequence
  Description of Artificial Sequence: Synthetic oligonucleotide
uaucaucaccucucaaaaugccc

SEQ ID NO: 366 - RNA, 23 nt, Artificial Sequence
  Description of Artificial Sequence: Synthetic oligonucleotide
uugaacaccuuucucccccugga

SEQ ID NO: 367 - RNA, 23 nt, Artificial Sequence
  Description of Artificial Sequence: Synthetic oligonucleotide
uuuaacaguuaauauauuuccag

SEQ ID NO: 368 - RNA, 23 nt, Artificial Sequence
  Description of Artificial Sequence: Synthetic oligonucleotide
aaggauuuuuccucaccaauguc

SEQ ID NO: 369 - RNA, 23 nt, Artificial Sequence
  Description of Artificial Sequence: Synthetic oligonucleotide
uaucuugaacaccuuucuccccc

SEQ ID NO: 370 - RNA, 23 nt, Artificial Sequence
  Description of Artificial Sequence: Synthetic oligonucleotide
aucaucaccucucaaaaugcccu

SEQ ID NO: 371 - RNA, 23 nt, Artificial Sequence
  Description of Artificial Sequence: Synthetic oligonucleotide
aaaagaacgacacccuuuguauu

SEQ ID NO: 372 - RNA, 23 nt, Artificial Sequence
  Description of Artificial Sequence: Synthetic oligonucleotide
ugauucgacaccaagaucccauu

SEQ ID NO: 373 - RNA, 23 nt, Artificial Sequence
  Description of Artificial Sequence: Synthetic oligonucleotide
uaaaauauugugcacugucagau

SEQ ID NO: 374 - RNA, 23 nt, Artificial Sequence
  Description of Artificial Sequence: Synthetic oligonucleotide
augggaaaauauugugcacuguc

SEQ ID NO: 375 - RNA, 23 nt, Artificial Sequence
  Description of Artificial Sequence: Synthetic oligonucleotide
uuaggacacccauugaaaaguca

SEQ ID NO: 376 - RNA, 23 nt, Artificial Sequence
  Description of Artificial Sequence: Synthetic oligonucleotide
aggauuuuuccucaccaaugucu

SEQ ID NO: 377 - RNA, 23 nt, Artificial Sequence
  Description of Artificial Sequence: Synthetic oligonucleotide
ucauugaaaagucaaaagcaaug

SEQ ID NO: 378 - RNA, 23 nt, Artificial Sequence
  Description of Artificial Sequence: Synthetic oligonucleotide
ucaucaucaccucucaaaaugcc

SEQ ID NO: 379 - RNA, 23 nt, Artificial Sequence
  Description of Artificial Sequence: Synthetic oligonucleotide
ugacacccauugaaaagucaaaa

SEQ ID NO: 380 - RNA, 23 nt, Artificial Sequence
  Description of Artificial Sequence: Synthetic oligonucleotide
ucuguccuaaaacagaagucgac

SEQ ID NO: 381 - RNA, 23 nt, Artificial Sequence
  Description of Artificial Sequence: Synthetic oligonucleotide
uauucuggcacccacucagagcc

SEQ ID NO: 382 - RNA, 23 nt, Artificial Sequence
  Description of Artificial Sequence: Synthetic oligonucleotide
uacuuucacauucuggcacccac

SEQ ID NO: 383 - RNA, 23 nt, Artificial Sequence
  Description of Artificial Sequence: Synthetic oligonucleotide
uguuccuaggacacccauugaaa

SEQ ID NO: 384 - RNA, 23 nt, Artificial Sequence
  Description of Artificial Sequence: Synthetic oligonucleotide
uaaugucuugucgaugacuuuca

SEQ ID NO: 385 - RNA, 23 nt, Artificial Sequence
  Description of Artificial Sequence: Synthetic oligonucleotide
ugcaucaucaccucucaaaaugc

SEQ ID NO: 386 - RNA, 23 nt, Artificial Sequence
  Description of Artificial Sequence: Synthetic oligonucleotide
ucucaccaaugucuugucgauga

SEQ ID NO: 387 - RNA, 23 nt, Artificial Sequence
  Description of Artificial Sequence: Synthetic oligonucleotide
ugacuuucacauucuggcaccca

SEQ ID NO: 388 - RNA, 23 nt, Artificial Sequence
  Description of Artificial Sequence: Synthetic oligonucleotide
uggaaaauauugugcacugucag

SEQ ID NO: 389 - RNA, 23 nt, Artificial Sequence
  Description of Artificial Sequence: Synthetic oligonucleotide
uucugcacagugucucuuuguca

SEQ ID NO: 390 - RNA, 23 nt, Artificial Sequence
  Description of Artificial Sequence: Synthetic oligonucleotide
uccuaggacacccauugaaaagu

SEQ ID NO: 391 - RNA, 23 nt, Artificial Sequence
  Description of Artificial Sequence: Synthetic oligonucleotide
acugucagaucuuggaaacggcc

SEQ ID NO: 392 - RNA, 23 nt, Artificial Sequence
  Description of Artificial Sequence: Synthetic oligonucleotide
uuugaacaccuuucucccccugg

SEQ ID NO: 393 - RNA, 23 nt, Artificial Sequence
  Description of Artificial Sequence: Synthetic oligonucleotide
accaaugucuugucgaugacuuu

SEQ ID NO: 394 - RNA, 21 nt, Artificial Sequence
  Description of Artificial Sequence: Synthetic oligonucleotide
gaaugugaaagucaucgacaa

SEQ ID NO: 395 - RNA, 21 nt, Artificial Sequence
  Description of Artificial Sequence: Synthetic oligonucleotide
uuuucaauggguguccuagga

SEQ ID NO: 396 - RNA, 21 nt, Artificial Sequence
  Description of Artificial Sequence: Synthetic oligonucleotide
gaaagucaucgacaagacauu

SEQ ID NO: 397 - RNA, 21 nt, Artificial Sequence
  Description of Artificial Sequence: Synthetic oligonucleotide
ucaucgacaagacauugguga

SEQ ID NO: 398 - RNA, 21 nt, Artificial Sequence
  Description of Artificial Sequence: Synthetic oligonucleotide
uuucaauggguguccuaggaa

SEQ ID NO: 399 - RNA, 21 nt, Artificial Sequence
  Description of Artificial Sequence: Synthetic oligonucleotide
aauggguguccuaggaaccuu

SEQ ID NO: 400 - RNA, 21 nt, Artificial Sequence
  Description of Artificial Sequence: Synthetic oligonucleotide
gacagugcacaauauuuucca

SEQ ID NO: 401 - RNA, 21 nt, Artificial Sequence
  Description of Artificial Sequence: Synthetic oligonucleotide
acuuuucaauggguguccuaa

SEQ ID NO: 402 - RNA, 21 nt, Artificial Sequence
  Description of Artificial Sequence: Synthetic oligonucleotide
aagucaucgacaagacauuga

SEQ ID NO: 403 - RNA, 21 nt, Artificial Sequence
  Description of Artificial Sequence: Synthetic oligonucleotide
aucgacaagacauuggugaga

SEQ ID NO: 404 - RNA, 21 nt, Artificial Sequence
  Description of Artificial Sequence: Synthetic oligonucleotide
gggagaaagguguucaagaua

SEQ ID NO: 405 - RNA, 21 nt, Artificial Sequence
  Description of Artificial Sequence: Synthetic oligonucleotide
cuuuucaauggguguccuaga

SEQ ID NO: 406 - RNA, 21 nt, Artificial Sequence
  Description of Artificial Sequence: Synthetic oligonucleotide
ucaauggguguccuaggaaca

SEQ ID NO: 407 - RNA, 21 nt, Artificial Sequence
  Description of Artificial Sequence: Synthetic oligonucleotide
uugacuuuucaauggguguca

SEQ ID NO: 408 - RNA, 21 nt, Artificial Sequence
  Description of Artificial Sequence: Synthetic oligonucleotide
aaagucaucgacaagacauua

SEQ ID NO: 409 - RNA, 21 nt, Artificial Sequence
  Description of Artificial Sequence: Synthetic oligonucleotide
cagggggagaaagguguucaa

SEQ ID NO: 410 - RNA, 21 nt, Artificial Sequence
  Description of Artificial Sequence: Synthetic oligonucleotide
cauuggugaggaaaaauccuu

SEQ ID NO: 411 - RNA, 21 nt, Artificial Sequence
  Description of Artificial Sequence: Synthetic oligonucleotide
acauuggugaggaaaaauccu

SEQ ID NO: 412 - RNA, 21 nt, Artificial Sequence
  Description of Artificial Sequence: Synthetic oligonucleotide
agggggagaaagguguucaaa

SEQ ID NO: 413 - RNA, 21 nt, Artificial Sequence
  Description of Artificial Sequence: Synthetic oligonucleotide
cucaggaugaaaaauuuugaa

SEQ ID NO: 414 - RNA, 21 nt, Artificial Sequence
  Description of Artificial Sequence: Synthetic oligonucleotide
cagcauguauuacuugacaaa

SEQ ID NO: 415 - RNA, 21 nt, Artificial Sequence
  Description of Artificial Sequence: Synthetic oligonucleotide
uaugaacaacaugcuaaauca

SEQ ID NO: 416 - RNA, 21 nt, Artificial Sequence
  Description of Artificial Sequence: Synthetic oligonucleotide
auauauccaaauguuuuagga

SEQ ID NO: 417 - RNA, 21 nt, Artificial Sequence
  Description of Artificial Sequence: Synthetic oligonucleotide
ccagauggaagcuguauccaa

SEQ ID NO: 418 - RNA, 21 nt, Artificial Sequence
  Description of Artificial Sequence: Synthetic oligonucleotide
gacuuucauccuggaaauaua

SEQ ID NO: 419 - RNA, 21 nt, Artificial Sequence
  Description of Artificial Sequence: Synthetic oligonucleotide
ccccggcuaauuuguaucaau

SEQ ID NO: 420 - RNA, 21 nt, Artificial Sequence
  Description of Artificial Sequence: Synthetic oligonucleotide
uuaaacauggcuugaauggga

SEQ ID NO: 421 - RNA, 21 nt, Artificial Sequence
  Description of Artificial Sequence: Synthetic oligonucleotide
aauguguuuagacaacgucau

SEQ ID NO: 422 - RNA, 21 nt, Artificial Sequence
  Description of Artificial Sequence: Synthetic oligonucleotide
acuaaaggaagaauuccgguu

SEQ ID NO: 423 - RNA, 21 nt, Artificial Sequence
  Description of Artificial Sequence: Synthetic oligonucleotide
uauauccaaauguuuuaggau

SEQ ID NO: 424 - RNA, 21 nt, Artificial Sequence
  Description of Artificial Sequence: Synthetic oligonucleotide
gugcggaaaggcacugauguu

SEQ ID NO: 425 - RNA, 21 nt, Artificial Sequence
  Description of Artificial Sequence: Synthetic oligonucleotide
uaaaacagugguucuuaaauu

SEQ ID NO: 426 - RNA, 21 nt, Artificial Sequence
  Description of Artificial Sequence: Synthetic oligonucleotide
augaaaaauuuugaaaccagu

SEQ ID NO: 427 - RNA, 21 nt, Artificial Sequence
  Description of Artificial Sequence: Synthetic oligonucleotide
aacaaaauagcaaucccuuuu

SEQ ID NO: 428 - RNA, 21 nt, Artificial Sequence
  Description of Artificial Sequence: Synthetic oligonucleotide
cugaaacagaucugucgacuu

SEQ ID NO: 429 - RNA, 21 nt, Artificial Sequence
  Description of Artificial Sequence: Synthetic oligonucleotide
uuguugcaaagggcauuuuga

SEQ ID NO: 430 - RNA, 21 nt, Artificial Sequence
  Description of Artificial Sequence: Synthetic oligonucleotide
cucauuguuuauuaaccugua

SEQ ID NO: 431 - RNA, 21 nt, Artificial Sequence
  Description of Artificial Sequence: Synthetic oligonucleotide
caacaaaauagcaaucccuuu

SEQ ID NO: 432 - RNA, 21 nt, Artificial Sequence
  Description of Artificial Sequence: Synthetic oligonucleotide
cauuguuuauuaaccuguauu

SEQ ID NO: 433 - RNA, 21 nt, Artificial Sequence
  Description of Artificial Sequence: Synthetic oligonucleotide
uaucagcugggaagauaucaa

SEQ ID NO: 434 - RNA, 21 nt, Artificial Sequence
  Description of Artificial Sequence: Synthetic oligonucleotide
uguccuaggaaccuuuuagaa

SEQ ID NO: 435 - RNA, 21 nt, Artificial Sequence
  Description of Artificial Sequence: Synthetic oligonucleotide
uccaacaaaauagcaaucccu

SEQ ID NO: 436 - RNA, 21 nt, Artificial Sequence
  Description of Artificial Sequence: Synthetic oligonucleotide
ggugugcggaaaggcacugau

SEQ ID NO: 437 - RNA, 21 nt, Artificial Sequence
  Description of Artificial Sequence: Synthetic oligonucleotide
uugaaaccaguacuuuaucau

SEQ ID NO: 438 - RNA, 21 nt, Artificial Sequence
  Description of Artificial Sequence: Synthetic oligonucleotide
uacuuccaaagucuauauaua

SEQ ID NO: 439 - RNA, 21 nt, Artificial Sequence
  Description of Artificial Sequence: Synthetic oligonucleotide
uccuaggaaccuuuuagaaau

SEQ ID NO: 440 - RNA, 21 nt, Artificial Sequence
  Description of Artificial Sequence: Synthetic oligonucleotide
cuccugaggaaaauuuuggaa

SEQ ID NO: 441 - RNA, 21 nt, Artificial Sequence
  Description of Artificial Sequence: Synthetic oligonucleotide
gcuccggaauguugcugaaau

SEQ ID NO: 442 - RNA, 21 nt, Artificial Sequence
  Description of Artificial Sequence: Synthetic oligonucleotide
guguuuguggggagaccaaua

SEQ ID NO: 443 - RNA, 23 nt, Artificial Sequence
  Description of Artificial Sequence: Synthetic oligonucleotide
uugucgaugacuuucacauucug

SEQ ID NO: 444 - RNA, 23 nt, Artificial Sequence
  Description of Artificial Sequence: Synthetic oligonucleotide
uccuaggacacccauugaaaagu

SEQ ID NO: 445 - RNA, 23 nt, Artificial Sequence
  Description of Artificial Sequence: Synthetic oligonucleotide
aaugucuugucgaugacuuucac

SEQ ID NO: 446 - RNA, 23 nt, Artificial Sequence
  Description of Artificial Sequence: Synthetic oligonucleotide
ucaccaaugucuugucgaugacu

SEQ ID NO: 447 - RNA, 23 nt, Artificial Sequence
  Description of Artificial Sequence: Synthetic oligonucleotide
uuccuaggacacccauugaaaag

SEQ ID NO: 448 - RNA, 23 nt, Artificial Sequence
  Description of Artificial Sequence: Synthetic oligonucleotide
aagguuccuaggacacccauuga

SEQ ID NO: 449 - RNA, 23 nt, Artificial Sequence
  Description of Artificial Sequence: Synthetic oligonucleotide
uggaaaauauugugcacugucag

SEQ ID NO: 450 - RNA, 23 nt, Artificial Sequence
  Description of Artificial Sequence: Synthetic oligonucleotide
uuaggacacccauugaaaaguca

SEQ ID NO: 451 - RNA, 23 nt, Artificial Sequence
  Description of Artificial Sequence: Synthetic oligonucleotide
ucaaugucuugucgaugacuuuc

SEQ ID NO: 452 - RNA, 23 nt, Artificial Sequence
  Description of Artificial Sequence: Synthetic oligonucleotide
ucucaccaaugucuugucgauga

SEQ ID NO: 453 - RNA, 23 nt, Artificial Sequence
  Description of Artificial Sequence: Synthetic oligonucleotide
uaucuugaacaccuuucuccccc

SEQ ID NO: 454 - RNA, 23 nt, Artificial Sequence
  Description of Artificial Sequence: Synthetic oligonucleotide
ucuaggacacccauugaaaaguc

SEQ ID NO: 455 - RNA, 23 nt, Artificial Sequence
  Description of Artificial Sequence: Synthetic oligonucleotide
uguuccuaggacacccauugaaa

SEQ ID NO: 456 - RNA, 23 nt, Artificial Sequence
  Description of Artificial Sequence: Synthetic oligonucleotide
ugacacccauugaaaagucaaaa

SEQ ID NO: 457 - RNA, 23 nt, Artificial Sequence
  Description of Artificial Sequence: Synthetic oligonucleotide
uaaugucuugucgaugacuuuca

SEQ ID NO: 458 - RNA, 23 nt, Artificial Sequence
  Description of Artificial Sequence: Synthetic oligonucleotide
uugaacaccuuucucccccugga

SEQ ID NO: 459 - RNA, 23 nt, Artificial Sequence
  Description of Artificial Sequence: Synthetic oligonucleotide
aaggauuuuuccucaccaauguc

SEQ ID NO: 460 - RNA, 23 nt, Artificial Sequence
  Description of Artificial Sequence: Synthetic oligonucleotide
aggauuuuuccucaccaaugucu

SEQ ID NO: 461 - RNA, 23 nt, Artificial Sequence
  Description of Artificial Sequence: Synthetic oligonucleotide
uuugaacaccuuucucccccugg

SEQ ID NO: 462 - RNA, 23 nt, Artificial Sequence
  Description of Artificial Sequence: Synthetic oligonucleotide
uucaaaauuuuucauccugaguu

SEQ ID NO: 463 - RNA, 23 nt, Artificial Sequence
  Description of Artificial Sequence: Synthetic oligonucleotide
uuugucaaguaauacaugcugaa

SEQ ID NO: 464 - RNA, 23 nt, Artificial Sequence
  Description of Artificial Sequence: Synthetic oligonucleotide
ugauuuagcauguuguucauaau

SEQ ID NO: 465 - RNA, 23 nt, Artificial Sequence
  Description of Artificial Sequence: Synthetic oligonucleotide
uccuaaaacauuuggauauauuc

SEQ ID NO: 466 - RNA, 23 nt, Artificial Sequence
  Description of Artificial Sequence: Synthetic oligonucleotide
uuggauacagcuuccaucuggaa

SEQ ID NO: 467 - RNA, 23 nt, Artificial Sequence
  Description of Artificial Sequence: Synthetic oligonucleotide
uauauuuccaggaugaaagucca

SEQ ID NO: 468 - RNA, 23 nt, Artificial Sequence
  Description of Artificial Sequence: Synthetic oligonucleotide
auugauacaaauuagccggggga

SEQ ID NO: 469 - RNA, 23 nt, Artificial Sequence
  Description of Artificial Sequence: Synthetic oligonucleotide
ucccauucaagccauguuuaaca

SEQ ID NO: 470 - RNA, 23 nt, Artificial Sequence
  Description of Artificial Sequence: Synthetic oligonucleotide
augacguugucuaaacacauuuu

SEQ ID NO: 471 - RNA, 23 nt, Artificial Sequence
  Description of Artificial Sequence: Synthetic oligonucleotide
aaccggaauucuuccuuuaguau

SEQ ID NO: 472 - RNA, 23 nt, Artificial Sequence
  Description of Artificial Sequence: Synthetic oligonucleotide
auccuaaaacauuuggauauauu

SEQ ID NO: 473 - RNA, 23 nt, Artificial Sequence
  Description of Artificial Sequence: Synthetic oligonucleotide
aacaucagugccuuuccgcacac

SEQ ID NO: 474 - RNA, 23 nt, Artificial Sequence
  Description of Artificial Sequence: Synthetic oligonucleotide
aauuuaagaaccacuguuuuaaa

SEQ ID NO: 475 - RNA, 23 nt, Artificial Sequence
  Description of Artificial Sequence: Synthetic oligonucleotide
acugguuucaaaauuuuucaucc

SEQ ID NO: 476 - RNA, 23 nt, Artificial Sequence
  Description of Artificial Sequence: Synthetic oligonucleotide
aaaagggauugcuauuuuguugg

SEQ ID NO: 477 - RNA, 23 nt, Artificial Sequence
  Description of Artificial Sequence: Synthetic oligonucleotide
aagucgacagaucuguuucagca

SEQ ID NO: 478 - RNA, 23 nt, Artificial Sequence
  Description of Artificial Sequence: Synthetic oligonucleotide
ucaaaaugcccuuugcaacaauu

SEQ ID NO: 479 - RNA, 23 nt, Artificial Sequence
  Description of Artificial Sequence: Synthetic oligonucleotide
uacagguuaauaaacaaugagau

SEQ ID NO: 480 - RNA, 23 nt, Artificial Sequence
  Description of Artificial Sequence: Synthetic oligonucleotide
aaagggauugcuauuuuguugga

SEQ ID NO: 481 - RNA, 23 nt, Artificial Sequence
  Description of Artificial Sequence: Synthetic oligonucleotide
aauacagguuaauaaacaaugag

SEQ ID NO: 482 - RNA, 23 nt, Artificial Sequence
  Description of Artificial Sequence: Synthetic oligonucleotide
uugauaucuucccagcugauaga

SEQ ID NO: 483 - RNA, 23 nt, Artificial Sequence
  Description of Artificial Sequence: Synthetic oligonucleotide
uucuaaaagguuccuaggacacc

SEQ ID NO: 484 - RNA, 23 nt, Artificial Sequence
  Description of Artificial Sequence: Synthetic oligonucleotide
agggauugcuauuuuguuggaaa

SEQ ID NO: 485 - RNA, 23 nt, Artificial Sequence
  Description of Artificial Sequence: Synthetic oligonucleotide
aucagugccuuuccgcacacccc

SEQ ID NO: 486 - RNA, 23 nt, Artificial Sequence
  Description of Artificial Sequence: Synthetic oligonucleotide
augauaaaguacugguuucaaaa

SEQ ID NO: 487 - RNA, 23 nt, Artificial Sequence
  Description of Artificial Sequence: Synthetic oligonucleotide
uauauauagacuuuggaaguacu

SEQ ID NO: 488 - RNA, 23 nt, Artificial Sequence
  Description of Artificial Sequence: Synthetic oligonucleotide
auuucuaaaagguuccuaggaca

SEQ ID NO: 489 - RNA, 23 nt, Artificial Sequence
  Description of Artificial Sequence: Synthetic oligonucleotide
uuccaaaauuuuccucaggagaa

SEQ ID NO: 490 - RNA, 23 nt, Artificial Sequence
  Description of Artificial Sequence: Synthetic oligonucleotide
auuucagcaacauuccggagcau

SEQ ID NO: 491 - RNA, 23 nt, Artificial Sequence
  Description of Artificial Sequence: Synthetic oligonucleotide
uauuggucuccccacaaacacag

SEQ ID NO: 492 - RNA, 21 nt, Artificial Sequence
  Description of Artificial Sequence: Synthetic oligonucleotide
auggugguaauuugugauuuu

SEQ ID NO: 493 - RNA, 21 nt, Artificial Sequence
  Description of Artificial Sequence: Synthetic oligonucleotide
gacuugcauccuggaaauaua

SEQ ID NO: 494 - RNA, 21 nt, Artificial Sequence
  Description of Artificial Sequence: Synthetic oligonucleotide
ggaagggaagguagaagucuu

SEQ ID NO: 495 - RNA, 21 nt, Artificial Sequence
  Description of Artificial Sequence: Synthetic oligonucleotide
ugucuucuguuuagauuuccu

SEQ ID NO: 496 - RNA, 21 nt, Artificial Sequence
  Description of Artificial Sequence: Synthetic oligonucleotide
cuuuggcuguuuccaagaucu

SEQ ID NO: 497 - RNA, 21 nt, Artificial Sequence
  Description of Artificial Sequence: Synthetic oligonucleotide
aauguguuugggcaacgucau

SEQ ID NO: 498 - RNA, 21 nt, Artificial Sequence
  Description of Artificial Sequence: Synthetic oligonucleotide
ugugacuguggacaccccuua

SEQ ID NO: 499 - RNA, 21 nt, Artificial Sequence
  Description of Artificial Sequence: Synthetic oligonucleotide
gauggggugccagcuacuauu

SEQ ID NO: 500 - RNA, 21 nt, Artificial Sequence
  Description of Artificial Sequence: Synthetic oligonucleotide
gaaaauguguuugggcaacgu

SEQ ID NO: 501 - RNA, 21 nt, Artificial Sequence
  Description of Artificial Sequence: Synthetic oligonucleotide
ggcuguuuccaagaucugaca

SEQ ID NO: 502 - RNA, 21 nt, Artificial Sequence
  Description of Artificial Sequence: Synthetic oligonucleotide
uccaacaaaauagccaccccu

SEQ ID NO: 503 - RNA, 21 nt, Artificial Sequence
  Description of Artificial Sequence: Synthetic oligonucleotide
gucuucuguuuagauuuccuu

SEQ ID NO: 504 - RNA, 21 nt, Artificial Sequence
  Description of Artificial Sequence: Synthetic oligonucleotide
uggaagggaagguagaagucu

SEQ ID NO: 505 - RNA, 21 nt, Artificial Sequence
  Description of Artificial Sequence: Synthetic oligonucleotide
uccuuuggcuguuuccaagau

SEQ ID NO: 506 - RNA, 21 nt, Artificial Sequence
  Description of Artificial Sequence: Synthetic oligonucleotide
caucucucagcugggaugaua

SEQ ID NO: 507 - RNA, 21 nt, Artificial Sequence
  Description of Artificial Sequence: Synthetic oligonucleotide
ggggugccagcuacuauugau

SEQ ID NO: 508 - RNA, 21 nt, Artificial Sequence
  Description of Artificial Sequence: Synthetic oligonucleotide
auguguuugggcaacgucaua

SEQ ID NO: 509 - RNA, 21 nt, Artificial Sequence
  Description of Artificial Sequence: Synthetic oligonucleotide
cuguuuagauuuccuuaagaa

SEQ ID NO: 510 - RNA, 21 nt, Artificial Sequence
  Description of Artificial Sequence: Synthetic oligonucleotide
agaaagaaauggacuugcaua

SEQ ID NO: 511 - RNA, 21 nt, Artificial Sequence
  Description of Artificial Sequence: Synthetic oligonucleotide
gcauccuggaaauauauuaaa

SEQ ID NO: 512 - RNA, 21 nt, Artificial Sequence
  Description of Artificial Sequence: Synthetic oligonucleotide
ccugucagaccaugggaacua

SEQ ID NO: 513 - RNA, 21 nt, Artificial Sequence
  Description of Artificial Sequence: Synthetic oligonucleotide
aaacaugguguggaugggaua

SEQ ID NO: 514 - RNA, 23 nt, Artificial Sequence
  Description of Artificial Sequence: Synthetic oligonucleotide
aaaaucacaaauuaccaccaucc

SEQ ID NO: 515 - RNA, 23 nt, Artificial Sequence
  Description of Artificial Sequence: Synthetic oligonucleotide
uauauuuccaggaugcaagucca

SEQ ID NO: 516 - RNA, 23 nt, Artificial Sequence
  Description of Artificial Sequence: Synthetic oligonucleotide
aagacuucuaccuucccuuccac

SEQ ID NO: 517 - RNA, 23 nt, Artificial Sequence
  Description of Artificial Sequence: Synthetic oligonucleotide
aggaaaucuaaacagaagacagg

SEQ ID NO: 518 - RNA, 23 nt, Artificial Sequence
  Description of Artificial Sequence: Synthetic oligonucleotide
agaucuuggaaacagccaaagga

SEQ ID NO: 519 - RNA, 23 nt, Artificial Sequence
  Description of Artificial Sequence: Synthetic oligonucleotide
augacguugcccaaacacauuuu

SEQ ID NO: 520 - RNA, 23 nt, Artificial Sequence
  Description of Artificial Sequence: Synthetic oligonucleotide
uaagggguguccacagucacaaa

SEQ ID NO: 521 - RNA, 23 nt, Artificial Sequence
  Description of Artificial Sequence: Synthetic oligonucleotide
aauaguagcuggcaccccaucca

SEQ ID NO: 522 - RNA, 23 nt, Artificial Sequence
  Description of Artificial Sequence: Synthetic oligonucleotide
acguugcccaaacacauuuucaa

SEQ ID NO: 523 - RNA, 23 nt, Artificial Sequence
  Description of Artificial Sequence: Synthetic oligonucleotide
ugucagaucuuggaaacagccaa

SEQ ID NO: 524 - RNA, 23 nt, Artificial Sequence
  Description of Artificial Sequence: Synthetic oligonucleotide
agggguggcuauuuuguuggaaa

SEQ ID NO: 525 - RNA, 23 nt, Artificial Sequence
  Description of Artificial Sequence: Synthetic oligonucleotide
aaggaaaucuaaacagaagacag

SEQ ID NO: 526 - RNA, 23 nt, Artificial Sequence
  Description of Artificial Sequence: Synthetic oligonucleotide
agacuucuaccuucccuuccaca

SEQ ID NO: 527 - RNA, 23 nt, Artificial Sequence
  Description of Artificial Sequence: Synthetic oligonucleotide
aucuuggaaacagccaaaggauu

SEQ ID NO: 528 - RNA, 23 nt, Artificial Sequence
  Description of Artificial Sequence: Synthetic oligonucleotide
uaucaucccagcugagagauggg

SEQ ID NO: 529 - RNA, 23 nt, Artificial Sequence
  Description of Artificial Sequence: Synthetic oligonucleotide
aucaauaguagcuggcaccccau

SEQ ID NO: 530 - RNA, 23 nt, Artificial Sequence
  Description of Artificial Sequence: Synthetic oligonucleotide
uaugacguugcccaaacacauuu

SEQ ID NO: 531 - RNA, 23 nt, Artificial Sequence
  Description of Artificial Sequence: Synthetic oligonucleotide
uucuuaaggaaaucuaaacagaa

SEQ ID NO: 532 - RNA, 23 nt, Artificial Sequence
  Description of Artificial Sequence: Synthetic oligonucleotide
uaugcaaguccauuucuuucuag

SEQ ID NO: 533 - RNA, 23 nt, Artificial Sequence
  Description of Artificial Sequence: Synthetic oligonucleotide
uuuaauauauuuccaggaugcaa

SEQ ID NO: 534 - RNA, 23 nt, Artificial Sequence
  Description of Artificial Sequence: Synthetic oligonucleotide
uaguucccauggucugacaggcu

SEQ ID NO: 535 - RNA, 23 nt, Artificial Sequence
  Description of Artificial Sequence: Synthetic oligonucleotide
uaucccauccacaccauguuuaa

SEQ ID NO: 536 - RNA, 21 nt, Artificial Sequence
  Description of Artificial Sequence: Synthetic oligonucleotide
gaaugugaaagucaucgacaa

SEQ ID NO: 537 - RNA, 21 nt, Artificial Sequence
  Description of Artificial Sequence: Synthetic oligonucleotide
gaaugugaaagucaucgacaa

SEQ ID NO: 538 - RNA, 21 nt, Artificial Sequence
  Description of Artificial Sequence: Synthetic oligonucleotide
gaaugugaaagucaucgacaa

SEQ ID NO: 539 - RNA, 21 nt, Artificial Sequence
  Description of Artificial Sequence: Synthetic oligonucleotide
gaaugugaaagucaucgacaa

SEQ ID NO: 540 - RNA, 21 nt, Artificial Sequence
  Description of Artificial Sequence: Synthetic oligonucleotide
gaaugugaaagucaucgacaa

SEQ ID NO: 541 - RNA, 21 nt, Artificial Sequence
  Description of Artificial Sequence: Synthetic oligonucleotide
gaaugugaaagucaucgacaa

SEQ ID NO: 542 - RNA, 21 nt, Artificial Sequence
  Description of Artificial Sequence: Synthetic oligonucleotide
gaaugugaaagucaucgacaa

SEQ ID NO: 543 - RNA, 21 nt, Artificial Sequence
  Description of Artificial Sequence: Synthetic oligonucleotide
gaaugugaaagucaucgacaa

SEQ ID NO: 544 - RNA, 19 nt, Artificial Sequence
  Description of Artificial Sequence: Synthetic oligonucleotide
augugaaagucaucgacaa

SEQ ID NO: 545 - RNA, 19 nt, Artificial Sequence
  Description of Artificial Sequence: Synthetic oligonucleotide
augugaaagucaucgacaa

SEQ ID NO: 546 - RNA, 21 nt, Artificial Sequence
  Description of Artificial Sequence: Synthetic oligonucleotide
gaaugugaaagucaucgacaa

SEQ ID NO: 547 - RNA, 21 nt, Artificial Sequence
  Description of Artificial Sequence: Synthetic oligonucleotide
gaaugugaaagucaucgacaa

SEQ ID NO: 548 - RNA, 21 nt, Artificial Sequence
  Description of Artificial Sequence: Synthetic oligonucleotide
gaaugugaaagucaucgacaa

SEQ ID NO: 549 - RNA, 21 nt, Artificial Sequence
  Description of Artificial Sequence: Synthetic oligonucleotide
gaaugugaaagucaucgacaa

SEQ ID NO: 550 - RNA, 21 nt, Artificial Sequence
  Description of Artificial Sequence: Synthetic oligonucleotide
gaaugugaaagucaucgacaa

SEQ ID NO: 551 - RNA, 21 nt, Artificial Sequence
  Description of Artificial Sequence: Synthetic oligonucleotide
gaaugugaaagucaucgacaa

SEQ ID NO: 552 - RNA, 21 nt, Artificial Sequence
  Description of Artificial Sequence: Synthetic oligonucleotide
gaaugugaaagucaucgacaa

SEQ ID NO: 553 - RNA, 21 nt, Artificial Sequence
  Description of Artificial Sequence: Synthetic oligonucleotide
gaaugugaaagucaucgacaa

SEQ ID NO: 554 - RNA, 21 nt, Artificial Sequence
  Description of Artificial Sequence: Synthetic oligonucleotide
gaaugugaaagucaucgacaa

SEQ ID NO: 555 - RNA, 21 nt, Artificial Sequence
  Description of Artificial Sequence: Synthetic oligonucleotide
gaaugugaaagucaucgacaa

SEQ ID NO: 556 - RNA, 21 nt, Artificial Sequence
  Description of Artificial Sequence: Synthetic oligonucleotide
gaaugugaaagucaucgacaa

SEQ ID NO: 557 - DNA, 21 bp, Artificial Sequence
  Description of Artificial Sequence: Synthetic oligonucleotide
  Description of Combined DNA/RNA Molecule: Synthetic oligonucleotide
gaaugtgaaagucaucgacaa

SEQ ID NO: 558 - RNA, 21 nt, Artificial Sequence
  Description of Artificial Sequence: Synthetic oligonucleotide
gaaugugaaagucaucgacaa

SEQ ID NO: 559 - DNA, 21 bp, Artificial Sequence
  Description of Artificial Sequence: Synthetic oligonucleotide
  Description of Combined DNA/RNA Molecule: Synthetic oligonucleotide
gaaugtgaaagucaucgacaa

SEQ ID NO: 560 - RNA, 21 nt, Artificial Sequence
  Description of Artificial Sequence: Synthetic oligonucleotide
gaaugugaaagucaucgacaa

SEQ ID NO: 561 - RNA, 21 nt, Artificial Sequence
  Description of Artificial Sequence: Synthetic oligonucleotide
gaaugugaaagucaucgacaa

SEQ ID NO: 562 - DNA, 21 bp, Artificial Sequence
  Description of Artificial Sequence: Synthetic oligonucleotide
  Description of Combined DNA/RNA Molecule: Synthetic oligonucleotide
gaaugugaaagucauctacaa

SEQ ID NO: 563 - RNA, 20 nt, Artificial Sequence
  Description of Artificial Sequence: Synthetic oligonucleotide
gaaugugaaagucaucacaa

SEQ ID NO: 564 - DNA, 21 bp, Artificial Sequence
  Description of Artificial Sequence: Synthetic oligonucleotide
  Description of Combined DNA/RNA Molecule: Synthetic oligonucleotide
gaaugugaaagucatctacaa

SEQ ID NO: 565 - RNA, 21 nt, Artificial Sequence
  Description of Artificial Sequence: Synthetic oligonucleotide
gaaugugaaagucaucgacaa

SEQ ID NO: 566 - DNA, 21 bp, Artificial Sequence
  Description of Artificial Sequence: Synthetic oligonucleotide
  Description of Combined DNA/RNA Molecule: Synthetic oligonucleotide
gaaugugaaagucauctacaa

SEQ ID NO: 567 - RNA, 20 nt, Artificial Sequence
  Description of Artificial Sequence: Synthetic oligonucleotide
gaaugugaaagucaucacaa

SEQ ID NO: 568 - RNA, 21 nt, Artificial Sequence
  Description of Artificial Sequence: Synthetic oligonucleotide
gaaugugaaagucaucgacaa

SEQ ID NO: 569 - RNA, 21 nt, Artificial Sequence
  Description of Artificial Sequence: Synthetic oligonucleotide
gaaugugaaagucaucgacaa

SEQ ID NO: 570 - RNA, 21 nt, Artificial Sequence
  Description of Artificial Sequence: Synthetic oligonucleotide
gaaugugaaagucaucgacaa

SEQ ID NO: 571 - RNA, 21 nt, Artificial Sequence
  Description of Artificial Sequence: Synthetic oligonucleotide
gaaugugaaagucaucgacaa

SEQ ID NO: 572 - RNA, 21 nt, Artificial Sequence
  Description of Artificial Sequence: Synthetic oligonucleotide
gaaugugaaagucaucgacaa

SEQ ID NO: 573 - RNA, 21 nt, Artificial Sequence
  Description of Artificial Sequence: Synthetic oligonucleotide
gaaugugaaagucaucgacaa

SEQ ID NO: 574 - RNA, 21 nt, Artificial Sequence
  Description of Artificial Sequence: Synthetic oligonucleotide
gaaugugaaagucaucgacaa

SEQ ID NO: 575 - RNA, 21 nt, Artificial Sequence
  Description of Artificial Sequence: Synthetic oligonucleotide
gacuuucauccuggaaauaua

SEQ ID NO: 576 - RNA, 21 nt, Artificial Sequence
  Description of Artificial Sequence: Synthetic oligonucleotide
gacuuucauccuggaaauaua

SEQ ID NO: 577 - RNA, 21 nt, Artificial Sequence
  Description of Artificial Sequence: Synthetic oligonucleotide
gacuuucauccuggaaauaua

SEQ ID NO: 578 - RNA, 21 nt, Artificial Sequence
  Description of Artificial Sequence: Synthetic oligonucleotide
gacuuucauccuggaaauaua

SEQ ID NO: 579 - RNA, 21 nt, Artificial Sequence
  Description of Artificial Sequence: Synthetic oligonucleotide
gacuuucauccuggaaauaua

SEQ ID NO: 580 - RNA, 21 nt, Artificial Sequence
  Description of Artificial Sequence: Synthetic oligonucleotide
gacuuucauccuggaaauaua

SEQ ID NO: 581 - RNA, 19 nt, Artificial Sequence
  Description of Artificial Sequence: Synthetic oligonucleotide
cuuucauccuggaaauaua

SEQ ID NO: 582 - RNA, 19 nt, Artificial Sequence
  Description of Artificial Sequence: Synthetic oligonucleotide
cuuucauccuggaaauaua

SEQ ID NO: 583 - RNA, 21 nt, Artificial Sequence
  Description of Artificial Sequence: Synthetic oligonucleotide
gacuuucauccuggaaauaua

SEQ ID NO: 584 - RNA, 21 nt, Artificial Sequence
  Description of Artificial Sequence: Synthetic oligonucleotide
gacuuucauccuggaaauaua

SEQ ID NO: 585 - RNA, 21 nt, Artificial Sequence
  Description of Artificial Sequence: Synthetic oligonucleotide
gacuuucauccuggaaauaua

SEQ ID NO: 586 - RNA, 21 nt, Artificial Sequence
  Description of Artificial Sequence: Synthetic oligonucleotide
gacuuucauccuggaaauaua

SEQ ID NO: 587 - RNA, 21 nt, Artificial Sequence
  Description of Artificial Sequence: Synthetic oligonucleotide
gacuuucauccuggaaauaua

SEQ ID NO: 588 - RNA, 21 nt, Artificial Sequence
  Description of Artificial Sequence: Synthetic oligonucleotide
gacuuucauccuggaaauaua

SEQ ID NO: 589 - RNA, 21 nt, Artificial Sequence
  Description of Artificial Sequence: Synthetic oligonucleotide
gacuuucauccuggaaauaua

SEQ ID NO: 590 - RNA, 21 nt, Artificial Sequence
  Description of Artificial Sequence: Synthetic oligonucleotide
gacuuucauccuggaaauaua

SEQ ID NO: 591 - RNA, 21 nt, Artificial Sequence
  Description of Artificial Sequence: Synthetic oligonucleotide
gacuuucauccuggaaauaua

SEQ ID NO: 592 - RNA, 21 nt, Artificial Sequence
  Description of Artificial Sequence: Synthetic oligonucleotide
gacuuucauccuggaaauaua

SEQ ID NO: 593 - RNA, 21 nt, Artificial Sequence
  Description of Artificial Sequence: Synthetic oligonucleotide
gacuuucauccuggaaauaua

SEQ ID NO: 594 - RNA, 21 nt, Artificial Sequence
  Description of Artificial Sequence: Synthetic oligonucleotide
gacuuucauccuggaaauaua

SEQ ID NO: 595 - RNA, 21 nt, Artificial Sequence
  Description of Artificial Sequence: Synthetic oligonucleotide
gacuuucauccuggaaauaua

SEQ ID NO: 596 - DNA, 21 bp, Artificial Sequence
  Description of Artificial Sequence: Synthetic oligonucleotide
  Description of Combined DNA/RNA Molecule: Synthetic oligonucleotide
gacutucauccuggaaauaua

SEQ ID NO: 597 - DNA, 21 bp, Artificial Sequence
  Description of Artificial Sequence: Synthetic oligonucleotide
  Description of Combined DNA/RNA Molecule: Synthetic oligonucleotide
gacuutcauccuggaaauaua

SEQ ID NO: 598 - RNA, 21 nt, Artificial Sequence
  Description of Artificial Sequence: Synthetic oligonucleotide
gacuuucauccuggaaauaua

SEQ ID NO: 599 - RNA, 21 nt, Artificial Sequence
  Description of Artificial Sequence: Synthetic oligonucleotide
gacuuucauccuggaaauaua

SEQ ID NO: 600 - DNA, 21 bp, Artificial Sequence
  Description of Artificial Sequence: Synthetic oligonucleotide
  Description of Combined DNA/RNA Molecule: Synthetic oligonucleotide
gacuuucauccuggaatuaua

SEQ ID NO: 601 - RNA, 20 nt, Artificial Sequence
  Description of Artificial Sequence: Synthetic oligonucleotide
gacuuucauccuggaauaua

SEQ ID NO: 602 - DNA, 21 bp, Artificial Sequence
  Description of Artificial Sequence: Synthetic oligonucleotide
  Description of Combined DNA/RNA Molecule: Synthetic oligonucleotide
gacuuucauccuggaatuaua

SEQ ID NO: 603 - DNA, 21 bp, Artificial Sequence
  Description of Artificial Sequence: Synthetic oligonucleotide
  Description of Combined DNA/RNA Molecule: Synthetic oligonucleotide
gacuuucauccuggaatuaua

SEQ ID NO: 604 - RNA, 21 nt, Artificial Sequence
  Description of Artificial Sequence: Synthetic oligonucleotide
gacuuucauccuggaaauaua

SEQ ID NO: 605 - DNA, 21 bp, Artificial Sequence
  Description of Artificial Sequence: Synthetic oligonucleotide
  Description of Combined DNA/RNA Molecule: Synthetic oligonucleotide
gacuutcauccuggaaauaua

SEQ ID NO: 606 - RNA, 21 nt, Artificial Sequence
  Description of Artificial Sequence: Synthetic oligonucleotide
gacuuucauccuggaaauaua

SEQ ID NO: 607 - RNA, 21 nt, Artificial Sequence
  Description of Artificial Sequence: Synthetic oligonucleotide
gacuuucauccuggaaauaua

SEQ ID NO: 608 - RNA, 21 nt, Artificial Sequence
  Description of Artificial Sequence: Synthetic oligonucleotide
gacuuucauccuggaaauaua

SEQ ID NO: 609 - RNA, 21 nt, Artificial Sequence
  Description of Artificial Sequence: Synthetic oligonucleotide
gacuuucauccuggaaauaua

SEQ ID NO: 610 - RNA, 21 nt, Artificial Sequence
  Description of Artificial Sequence: Synthetic oligonucleotide
gacuuucauccuggaaauaua

SEQ ID NO: 611 - RNA, 21 nt, Artificial Sequence
  Description of Artificial Sequence: Synthetic oligonucleotide
gacuuucauccuggaaauaua

SEQ ID NO: 612 - RNA, 21 nt, Artificial Sequence
  Description of Artificial Sequence: Synthetic oligonucleotide
gacuuucauccuggaaauaua

SEQ ID NO: 613 - RNA, 21 nt, Artificial Sequence
  Description of Artificial Sequence: Synthetic oligonucleotide
gacuuucauccuggaaauaua

SEQ ID NO: 614 - RNA, 21 nt, Artificial Sequence
  Description of Artificial Sequence: Synthetic oligonucleotide
agaaagguguucaagauguca

SEQ ID NO: 615 - RNA, 21 nt, Artificial Sequence
  Description of Artificial Sequence: Synthetic oligonucleotide
cauccuggaaauauauuaacu

SEQ ID NO: 616 - RNA, 21 nt, Artificial Sequence
  Description of Artificial Sequence: Synthetic oligonucleotide
gaaugugaaagucaucgacaa

SEQ ID NO: 617 - RNA, 21 nt, Artificial Sequence
  Description of Artificial Sequence: Synthetic oligonucleotide
agugcacaauauuuucccaua

SEQ ID NO: 618 - RNA, 21 nt, Artificial Sequence
  Description of Artificial Sequence: Synthetic oligonucleotide
gaaagucaucgacaagacauu

SEQ ID NO: 619 - RNA, 21 nt, Artificial Sequence
  Description of Artificial Sequence: Synthetic oligonucleotide
aaugugaaagucaucgacaaa

SEQ ID NO: 620 - RNA, 21 nt, Artificial Sequence
  Description of Artificial Sequence: Synthetic oligonucleotide
cuggaaauauauuaacuguua

SEQ ID NO: 621 - RNA, 21 nt, Artificial Sequence
  Description of Artificial Sequence: Synthetic oligonucleotide
auuuucccaucuguauuauuu

SEQ ID NO: 622 - RNA, 21 nt, Artificial Sequence
  Description of Artificial Sequence: Synthetic oligonucleotide
ugucguucuuuuccaacaaaa

SEQ ID NO: 623 - RNA, 21 nt, Artificial Sequence
  Description of Artificial Sequence: Synthetic oligonucleotide
auccuggaaauauauuaacua

SEQ ID NO: 624 - RNA, 21 nt, Artificial Sequence
  Description of Artificial Sequence: Synthetic oligonucleotide
gcauuuugagaggugaugaua

SEQ ID NO: 625 - RNA, 21 nt, Artificial Sequence
  Description of Artificial Sequence: Synthetic oligonucleotide
cagggggagaaagguguucaa

SEQ ID NO: 626 - RNA, 21 nt, Artificial Sequence
  Description of Artificial Sequence: Synthetic oligonucleotide
ggaaauauauuaacuguuaaa

SEQ ID NO: 627 - RNA, 21 nt, Artificial Sequence
  Description of Artificial Sequence: Synthetic oligonucleotide
cauuggugaggaaaaauccuu

SEQ ID NO: 628 - RNA, 21 nt, Artificial Sequence
  Description of Artificial Sequence: Synthetic oligonucleotide
gggagaaagguguucaagaua

SEQ ID NO: 629 - RNA, 21 nt, Artificial Sequence
  Description of Artificial Sequence: Synthetic oligonucleotide
ggcauuuugagaggugaugau

SEQ ID NO: 630 - RNA, 21 nt, Artificial Sequence
  Description of Artificial Sequence: Synthetic oligonucleotide
uacaaagggugucguucuuuu

SEQ ID NO: 631 - RNA, 21 nt, Artificial Sequence
  Description of Artificial Sequence: Synthetic oligonucleotide
ugggaucuuggugucgaauca

SEQ ID NO: 632 - RNA, 21 nt, Artificial Sequence
  Description of Artificial Sequence: Synthetic oligonucleotide
cugacagugcacaauauuuua

SEQ ID NO: 633 - RNA, 21 nt, Artificial Sequence
  Description of Artificial Sequence: Synthetic oligonucleotide
cagugcacaauauuuucccau

SEQ ID NO: 634 - RNA, 21 nt, Artificial Sequence
  Description of Artificial Sequence: Synthetic oligonucleotide
acuuuucaauggguguccuaa

SEQ ID NO: 635 - RNA, 21 nt, Artificial Sequence
  Description of Artificial Sequence: Synthetic oligonucleotide
acauuggugaggaaaaauccu

SEQ ID NO: 636 - RNA, 21 nt, Artificial Sequence
  Description of Artificial Sequence: Synthetic oligonucleotide
uugcuuuugacuuuucaauga

SEQ ID NO: 637 - RNA, 21 nt, Artificial Sequence
  Description of Artificial Sequence: Synthetic oligonucleotide
cauuuugagaggugaugauga

SEQ ID NO: 638 - RNA, 21 nt, Artificial Sequence
  Description of Artificial Sequence: Synthetic oligonucleotide
uugacuuuucaauggguguca

SEQ ID NO: 639 - RNA, 21 nt, Artificial Sequence
  Description of Artificial Sequence: Synthetic oligonucleotide
cgacuucuguuuuaggacaga

SEQ ID NO: 640 - RNA, 21 nt, Artificial Sequence
  Description of Artificial Sequence: Synthetic oligonucleotide
cucugagugggugccagaaua

SEQ ID NO: 641 - RNA, 21 nt, Artificial Sequence
  Description of Artificial Sequence: Synthetic oligonucleotide
gggugccagaaugugaaagua

SEQ ID NO: 642 - RNA, 21 nt, Artificial Sequence
  Description of Artificial Sequence: Synthetic oligonucleotide
ucaauggguguccuaggaaca

SEQ ID NO: 643 - RNA, 21 nt, Artificial Sequence
  Description of Artificial Sequence: Synthetic oligonucleotide
aaagucaucgacaagacauua

SEQ ID NO: 644 - RNA, 21 nt, Artificial Sequence
  Description of Artificial Sequence: Synthetic oligonucleotide
auuuugagaggugaugaugca

SEQ ID NO: 645 - RNA, 21 nt, Artificial Sequence
  Description of Artificial Sequence: Synthetic oligonucleotide
aucgacaagacauuggugaga

SEQ ID NO: 646 - RNA, 21 nt, Artificial Sequence
  Description of Artificial Sequence: Synthetic oligonucleotide
ggugccagaaugugaaaguca

SEQ ID NO: 647 - RNA, 21 nt, Artificial Sequence
  Description of Artificial Sequence: Synthetic oligonucleotide
gacagugcacaauauuuucca

SEQ ID NO: 648 - RNA, 21 nt, Artificial Sequence
  Description of Artificial Sequence: Synthetic oligonucleotide
acaaagagacacugugcagaa

SEQ ID NO: 649 - RNA, 21 nt, Artificial Sequence
  Description of Artificial Sequence: Synthetic oligonucleotide
uuuucaauggguguccuagga

SEQ ID NO: 650 - RNA, 21 nt, Artificial Sequence
  Description of Artificial Sequence: Synthetic oligonucleotide
ccguuuccaagaucugacagu

SEQ ID NO: 651 - RNA, 21 nt, Artificial Sequence
  Description of Artificial Sequence: Synthetic oligonucleotide
agggggagaaagguguucaaa

SEQ ID NO: 652 - RNA, 21 nt, Artificial Sequence
  Description of Artificial Sequence: Synthetic oligonucleotide
agucaucgacaagacauuggu

SEQ ID NO: 653 - RNA, 23 nt, Artificial Sequence
  Description of Artificial Sequence: Synthetic oligonucleotide
uugucgaugacuuucacauucug

SEQ ID NO: 654 - RNA, 23 nt, Artificial Sequence
  Description of Artificial Sequence: Synthetic oligonucleotide
uugucgaugacuuucacauucug

SEQ ID NO: 655 - RNA, 23 nt, Artificial Sequence
  Description of Artificial Sequence: Synthetic oligonucleotide
uugucgaugacuuucacauucug

SEQ ID NO: 656 - RNA, 23 nt, Artificial Sequence
  Description of Artificial Sequence: Synthetic oligonucleotide
uugucgaugacuuucacauucug

SEQ ID NO: 657 - RNA, 23 nt, Artificial Sequence
  Description of Artificial Sequence: Synthetic oligonucleotide
uugucgaugacuuucacauucug

SEQ ID NO: 658 - RNA, 23 nt, Artificial Sequence
  Description of Artificial Sequence: Synthetic oligonucleotide
uugucgaugacuuucacauucug

SEQ ID NO: 659 - RNA, 23 nt, Artificial Sequence
  Description of Artificial Sequence: Synthetic oligonucleotide
uugucgaugacuuucacauucug

SEQ ID NO: 660 - RNA, 23 nt, Artificial Sequence
  Description of Artificial Sequence: Synthetic oligonucleotide
uugucgaugacuuucacauucug

SEQ ID NO: 661 - RNA, 21 nt, Artificial Sequence
  Description of Artificial Sequence: Synthetic oligonucleotide
uugucgaugacuuucacauuc

SEQ ID NO: 662 - RNA, 21 nt, Artificial Sequence
  Description of Artificial Sequence: Synthetic oligonucleotide
uugucgaugacuuucacauuc

SEQ ID NO: 663 - RNA, 23 nt, Artificial Sequence
  Description of Artificial Sequence: Synthetic oligonucleotide
uugucgaugacuuucacauucug

SEQ ID NO: 664 - RNA, 23 nt, Artificial Sequence
  Description of Artificial Sequence: Synthetic oligonucleotide
uugucgaugacuuucacauucug

SEQ ID NO: 665 - RNA, 23 nt, Artificial Sequence
  Description of Artificial Sequence: Synthetic oligonucleotide
uugucgaugacuuucacauucug

SEQ ID NO: 666 - RNA, 23 nt, Artificial Sequence
  Description of Artificial Sequence: Synthetic oligonucleotide
uugucgaugacuuucacauucug

SEQ ID NO: 667 - RNA, 23 nt, Artificial Sequence
  Description of Artificial Sequence: Synthetic oligonucleotide
uugucgaugacuuucacauucug

SEQ ID NO: 668 - RNA, 23 nt, Artificial Sequence
  Description of Artificial Sequence: Synthetic oligonucleotide
uugucgaugacuuucacauucug

SEQ ID NO: 669 - RNA, 23 nt, Artificial Sequence
  Description of Artificial Sequence: Synthetic oligonucleotide
uugucgaugacuuucacauucug

SEQ ID NO: 670 - RNA, 23 nt, Artificial Sequence
  Description of Artificial Sequence: Synthetic oligonucleotide
uugucgaugacuuucacauucug

SEQ ID NO: 671 - RNA, 23 nt, Artificial Sequence
  Description of Artificial Sequence: Synthetic oligonucleotide
uugucgaugacuuucacauucug

SEQ ID NO: 672 - RNA, 23 nt, Artificial Sequence
  Description of Artificial Sequence: Synthetic oligonucleotide
uugucgaugacuuucacauucug

SEQ ID NO: 673 - RNA, 23 nt, Artificial Sequence
  Description of Artificial Sequence: Synthetic oligonucleotide
uugucgaugacuuucacauucug

SEQ ID NO: 674 - RNA, 23 nt, Artificial Sequence
  Description of Artificial Sequence: Synthetic oligonucleotide
uugucgaugacuuucacauucug

SEQ ID NO: 675 - RNA, 23 nt, Artificial Sequence
  Description of Artificial Sequence: Synthetic oligonucleotide
uugucgaugacuuucacauucug

SEQ ID NO: 676 - RNA, 23 nt, Artificial Sequence
  Description of Artificial Sequence: Synthetic oligonucleotide
uugucgaugacuuucacauucug

SEQ ID NO: 677 - RNA, 23 nt, Artificial Sequence
  Description of Artificial Sequence: Synthetic oligonucleotide
uugucgaugacuuucacauucug

SEQ ID NO: 678 - RNA, 23 nt, Artificial Sequence
  Description of Artificial Sequence: Synthetic oligonucleotide
uugucgaugacuuucacauucug

SEQ ID NO: 679 - RNA, 23 nt, Artificial Sequence
  Description of Artificial Sequence: Synthetic oligonucleotide
uugucgaugacuuucacauucug

SEQ ID NO: 680 - RNA, 23 nt, Artificial Sequence
  Description of Artificial Sequence: Synthetic oligonucleotide
uugucgaugacuuucacauucug

SEQ ID NO: 681 - RNA, 23 nt, Artificial Sequence
  Description of Artificial Sequence: Synthetic oligonucleotide
uugucgaugacuuucacauucug

SEQ ID NO: 682 - RNA, 23 nt, Artificial Sequence
  Description of Artificial Sequence: Synthetic oligonucleotide
uugucgaugacuuucacauucug

SEQ ID NO: 683 - RNA, 23 nt, Artificial Sequence
  Description of Artificial Sequence: Synthetic oligonucleotide
uugucgaugacuuucacauucug

SEQ ID NO: 684 - RNA, 23 nt, Artificial Sequence
  Description of Artificial Sequence: Synthetic oligonucleotide
uugucgaugacuuucacauucug

SEQ ID NO: 685 - DNA, 23 bp, Artificial Sequence
  Description of Artificial Sequence: Synthetic oligonucleotide
  Description of Combined DNA/RNA Molecule: Synthetic oligonucleotide
utgucgaugacuutcacauucug

SEQ ID NO: 686 - DNA, 23 bp, Artificial Sequence
  Description of Artificial Sequence: Synthetic oligonucleotide
  Description of Combined DNA/RNA Molecule: Synthetic oligonucleotide
uugucgaugacuutcacauucug

SEQ ID NO: 687 - DNA, 23 bp, Artificial Sequence
  Description of Artificial Sequence: Synthetic oligonucleotide
  Description of Combined DNA/RNA Molecule: Synthetic oligonucleotide
utgucgaugacuutcacauucug

SEQ ID NO: 688 - DNA, 23 bp, Artificial Sequence
  Description of Artificial Sequence: Synthetic oligonucleotide
  Description of Combined DNA/RNA Molecule: Synthetic oligonucleotide
uugucgaugacuutcacauucug

SEQ ID NO: 689 - DNA, 23 bp, Artificial Sequence
  Description of Artificial Sequence: Synthetic oligonucleotide
  Description of Combined DNA/RNA Molecule: Synthetic oligonucleotide
utgucgaugacuutcacauucug

SEQ ID NO: 690 - DNA, 23 bp, Artificial Sequence
  Description of Artificial Sequence: Synthetic oligonucleotide
  Description of Combined DNA/RNA Molecule: Synthetic oligonucleotide
utgucgaugacuutcacauucug

SEQ ID NO: 691 - DNA, 23 bp, Artificial Sequence
  Description of Artificial Sequence: Synthetic oligonucleotide
  Description of Combined DNA/RNA Molecule: Synthetic oligonucleotide
utgucgaugacuutcacauucug

SEQ ID NO: 692 - RNA, 23 nt, Artificial Sequence
  Description of Artificial Sequence: Synthetic oligonucleotide
uauauuuccaggaugaaagucca

SEQ ID NO: 693 - RNA, 23 nt, Artificial Sequence
  Description of Artificial Sequence: Synthetic oligonucleotide
uauauuuccaggaugaaagucca

SEQ ID NO: 694 - RNA, 23 nt, Artificial Sequence
  Description of Artificial Sequence: Synthetic oligonucleotide
uauauuuccaggaugaaagucca

SEQ ID NO: 695 - RNA, 23 nt, Artificial Sequence
  Description of Artificial Sequence: Synthetic oligonucleotide
uauauuuccaggaugaaagucca

SEQ ID NO: 696 - RNA, 23 nt, Artificial Sequence
  Description of Artificial Sequence: Synthetic oligonucleotide
uauauuuccaggaugaaagucca

SEQ ID NO: 697 - RNA, 23 nt, Artificial Sequence
  Description of Artificial Sequence: Synthetic oligonucleotide
uauauuuccaggaugaaagucca

SEQ ID NO: 698 - RNA, 21 nt, Artificial Sequence
  Description of Artificial Sequence: Synthetic oligonucleotide
uauauuuccaggaugaaaguc

SEQ ID NO: 699 - RNA, 21 nt, Artificial Sequence
  Description of Artificial Sequence: Synthetic oligonucleotide
uauauuuccaggaugaaaguc

SEQ ID NO: 700 - RNA, 23 nt, Artificial Sequence
  Description of Artificial Sequence: Synthetic oligonucleotide
uauauuuccaggaugaaagucca

SEQ ID NO: 701 - RNA, 23 nt, Artificial Sequence
  Description of Artificial Sequence: Synthetic oligonucleotide
uauauuuccaggaugaaagucca

SEQ ID NO: 702 - RNA, 23 nt, Artificial Sequence
  Description of Artificial Sequence: Synthetic oligonucleotide
uauauuuccaggaugaaagucca

SEQ ID NO: 703 - RNA, 23 nt, Artificial Sequence
  Description of Artificial Sequence: Synthetic oligonucleotide
uauauuuccaggaugaaagucca

SEQ ID NO: 704 - RNA, 23 nt, Artificial Sequence
  Description of Artificial Sequence: Synthetic oligonucleotide
uauauuuccaggaugaaagucca

SEQ ID NO: 705 - RNA, 23 nt, Artificial Sequence
  Description of Artificial Sequence: Synthetic oligonucleotide
uauauuuccaggaugaaagucca

SEQ ID NO: 706 - RNA, 23 nt, Artificial Sequence
  Description of Artificial Sequence: Synthetic oligonucleotide
uauauuuccaggaugaaagucca

SEQ ID NO: 707 - RNA, 23 nt, Artificial Sequence
  Description of Artificial Sequence: Synthetic oligonucleotide
uauauuuccaggaugaaagucca

SEQ ID NO: 708 - RNA, 23 nt, Artificial Sequence
  Description of Artificial Sequence: Synthetic oligonucleotide
uauauuuccaggaugaaagucca

SEQ ID NO: 709 - RNA, 23 nt, Artificial Sequence
  Description of Artificial Sequence: Synthetic oligonucleotide
uauauuuccaggaugaaagucca

SEQ ID NO: 710 - RNA, 23 nt, Artificial Sequence
  Description of Artificial Sequence: Synthetic oligonucleotide
uauauuuccaggaugaaagucca

SEQ ID NO: 711 - RNA, 23 nt, Artificial Sequence
  Description of Artificial Sequence: Synthetic oligonucleotide
uauauuuccaggaugaaagucca

SEQ ID NO: 712 - RNA, 23 nt, Artificial Sequence
  Description of Artificial Sequence: Synthetic oligonucleotide
uauauuuccaggaugaaagucca

SEQ ID NO: 713 - RNA, 23 nt, Artificial Sequence
  Description of Artificial Sequence: Synthetic oligonucleotide
uauauuuccaggaugaaagucca

SEQ ID NO: 714 - RNA, 23 nt, Artificial Sequence
  Description of Artificial Sequence: Synthetic oligonucleotide
uauauuuccaggaugaaagucca

SEQ ID NO: 715 - RNA, 23 nt, Artificial Sequence
  Description of Artificial Sequence: Synthetic oligonucleotide
uauauuuccaggaugaaagucca

SEQ ID NO: 716 - RNA, 23 nt, Artificial Sequence
  Description of Artificial Sequence: Synthetic oligonucleotide
uauauuuccaggaugaaagucca

SEQ ID NO: 717 - RNA, 23 nt, Artificial Sequence
  Description of Artificial Sequence: Synthetic oligonucleotide
uauauuuccaggaugaaagucca

SEQ ID NO: 718 - RNA, 23 nt, Artificial Sequence
  Description of Artificial Sequence: Synthetic oligonucleotide
uauauuuccaggaugaaagucca

SEQ ID NO: 719 - RNA, 23 nt, Artificial Sequence
  Description of Artificial Sequence: Synthetic oligonucleotide
uauauuuccaggaugaaagucca

SEQ ID NO: 720 - RNA, 23 nt, Artificial Sequence
  Description of Artificial Sequence: Synthetic oligonucleotide
uauauuuccaggaugaaagucca

SEQ ID NO: 721 - RNA, 23 nt, Artificial Sequence
  Description of Artificial Sequence: Synthetic oligonucleotide
uauauuuccaggaugaaagucca

SEQ ID NO: 722 - RNA, 23 nt, Artificial Sequence
  Description of Artificial Sequence: Synthetic oligonucleotide
uauauuuccaggaugaaagucca

SEQ ID NO: 723 - DNA, 23 bp, Artificial Sequence
  Description of Artificial Sequence: Synthetic oligonucleotide
  Description of Combined DNA/RNA Molecule: Synthetic oligonucleotide
uauauuuccaggatgaaagucca

SEQ ID NO: 724 - DNA, 23 bp, Artificial Sequence
  Description of Artificial Sequence: Synthetic oligonucleotide
  Description of Combined DNA/RNA Molecule: Synthetic oligonucleotide
uauauuuccaggatgaaagucca

SEQ ID NO: 725 - DNA, 23 bp, Artificial Sequence
  Description of Artificial Sequence: Synthetic oligonucleotide
  Description of Combined DNA/RNA Molecule: Synthetic oligonucleotide
uauauuuccaggatgaaagucca

SEQ ID NO: 726 - DNA, 23 bp, Artificial Sequence
  Description of Artificial Sequence: Synthetic oligonucleotide
  Description of Combined DNA/RNA Molecule: Synthetic oligonucleotide
uauautuccaggatgaaagucca

SEQ ID NO: 727 - DNA, 23 bp, Artificial Sequence
  Description of Artificial Sequence: Synthetic oligonucleotide
  Description of Combined DNA/RNA Molecule: Synthetic oligonucleotide
uauautuccaggatgaaagucca

SEQ ID NO: 728 - DNA, 23 bp, Artificial Sequence
  Description of Artificial Sequence: Synthetic oligonucleotide
  Description of Combined DNA/RNA Molecule: Synthetic oligonucleotide
uauauuuccaggatgaaagucca

SEQ ID NO: 729 - DNA, 23 bp, Artificial Sequence
  Description of Artificial Sequence: Synthetic oligonucleotide
  Description of Combined DNA/RNA Molecule: Synthetic oligonucleotide
uauautuccaggatgaaagucca

SEQ ID NO: 730 - DNA, 23 bp, Artificial Sequence
  Description of Artificial Sequence: Synthetic oligonucleotide
  Description of Combined DNA/RNA Molecule: Synthetic oligonucleotide
uauauuuccaggatgaaagucca

SEQ ID NO: 731 - RNA, 23 nt, Artificial Sequence
  Description of Artificial Sequence: Synthetic oligonucleotide
ugacaucuugaacaccuuucucc

SEQ ID NO: 732 - RNA, 23 nt, Artificial Sequence
  Description of Artificial Sequence: Synthetic oligonucleotide
aguuaauauauuuccaggaugaa

SEQ ID NO: 733 - RNA, 23 nt, Artificial Sequence
  Description of Artificial Sequence: Synthetic oligonucleotide
uugucgaugacuuucacauucug

SEQ ID NO: 734 - RNA, 23 nt, Artificial Sequence
  Description of Artificial Sequence: Synthetic oligonucleotide
uaugggaaaauauugugcacugu

SEQ ID NO: 735 - RNA, 23 nt, Artificial Sequence
  Description of Artificial Sequence: Synthetic oligonucleotide
aaugucuugucgaugacuuucac

SEQ ID NO: 736 - RNA, 23 nt, Artificial Sequence
  Description of Artificial Sequence: Synthetic oligonucleotide
uuugucgaugacuuucacauucu

SEQ ID NO: 737 - RNA, 23 nt, Artificial Sequence
  Description of Artificial Sequence: Synthetic oligonucleotide
uaacaguuaauauauuuccagga

SEQ ID NO: 738 - RNA, 23 nt, Artificial Sequence
  Description of Artificial Sequence: Synthetic oligonucleotide
aaauaauacagaugggaaaauau

SEQ ID NO: 739 - RNA, 23 nt, Artificial Sequence
  Description of Artificial Sequence: Synthetic oligonucleotide
uuuuguuggaaaagaacgacacc

SEQ ID NO: 740 - RNA, 23 nt, Artificial Sequence
  Description of Artificial Sequence: Synthetic oligonucleotide
uaguuaauauauuuccaggauga

SEQ ID NO: 741 - RNA, 23 nt, Artificial Sequence
  Description of Artificial Sequence: Synthetic oligonucleotide
uaucaucaccucucaaaaugccc

SEQ ID NO: 742 - RNA, 23 nt, Artificial Sequence
  Description of Artificial Sequence: Synthetic oligonucleotide
uugaacaccuuucucccccugga

SEQ ID NO: 743 - RNA, 23 nt, Artificial Sequence
  Description of Artificial Sequence: Synthetic oligonucleotide
uuuaacaguuaauauauuuccag

SEQ ID NO: 744 - RNA, 23 nt, Artificial Sequence
  Description of Artificial Sequence: Synthetic oligonucleotide
aaggauuuuuccucaccaauguc

SEQ ID NO: 745 - RNA, 23 nt, Artificial Sequence
  Description of Artificial Sequence: Synthetic oligonucleotide
uaucuugaacaccuuucuccccc

SEQ ID NO: 746 - RNA, 23 nt, Artificial Sequence
  Description of Artificial Sequence: Synthetic oligonucleotide
aucaucaccucucaaaaugcccu

SEQ ID NO: 747 - RNA, 23 nt, Artificial Sequence
  Description of Artificial Sequence: Synthetic oligonucleotide
aaaagaacgacacccuuuguauu

SEQ ID NO: 748 - RNA, 23 nt, Artificial Sequence
  Description of Artificial Sequence: Synthetic oligonucleotide
ugauucgacaccaagaucccauu

SEQ ID NO: 749 - RNA, 23 nt, Artificial Sequence
  Description of Artificial Sequence: Synthetic oligonucleotide
uaaaauauugugcacugucagau

SEQ ID NO: 750 - RNA, 23 nt, Artificial Sequence
  Description of Artificial Sequence: Synthetic oligonucleotide
augggaaaauauugugcacuguc

SEQ ID NO: 751 - RNA, 23 nt, Artificial Sequence
  Description of Artificial Sequence: Synthetic oligonucleotide
uuaggacacccauugaaaaguca

SEQ ID NO: 752 - RNA, 23 nt, Artificial Sequence
  Description of Artificial Sequence: Synthetic oligonucleotide
aggauuuuuccucaccaaugucu

SEQ ID NO: 753 - RNA, 23 nt, Artificial Sequence
  Description of Artificial Sequence: Synthetic oligonucleotide
ucauugaaaagucaaaagcaaug

SEQ ID NO: 754 - RNA, 23 nt, Artificial Sequence
  Description of Artificial Sequence: Synthetic oligonucleotide
ucaucaucaccucucaaaaugcc

SEQ ID NO: 755 - RNA, 23 nt, Artificial Sequence
  Description of Artificial Sequence: Synthetic oligonucleotide
ugacacccauugaaaagucaaaa

SEQ ID NO: 756 - RNA, 23 nt, Artificial Sequence
  Description of Artificial Sequence: Synthetic oligonucleotide
ucuguccuaaaacagaagucgac

SEQ ID NO: 757 - RNA, 23 nt, Artificial Sequence
  Description of Artificial Sequence: Synthetic oligonucleotide
uauucuggcacccacucagagcc

SEQ ID NO: 758 - RNA, 23 nt, Artificial Sequence
  Description of Artificial Sequence: Synthetic oligonucleotide
uacuuucacauucuggcacccac

SEQ ID NO: 759 - RNA, 23 nt, Artificial Sequence
  Description of Artificial Sequence: Synthetic oligonucleotide
uguuccuaggacacccauugaaa

SEQ ID NO: 760 - RNA, 23 nt, Artificial Sequence
  Description of Artificial Sequence: Synthetic oligonucleotide
uaaugucuugucgaugacuuuca

SEQ ID NO: 761 - RNA, 23 nt, Artificial Sequence
  Description of Artificial Sequence: Synthetic oligonucleotide
ugcaucaucaccucucaaaaugc

SEQ ID NO: 762 - RNA, 23 nt, Artificial Sequence
  Description of Artificial Sequence: Synthetic oligonucleotide
ucucaccaaugucuugucgauga

SEQ ID NO: 763 - RNA, 23 nt, Artificial Sequence
  Description of Artificial Sequence: Synthetic oligonucleotide
ugacuuucacauucuggcaccca

SEQ ID NO: 764 - RNA, 23 nt, Artificial Sequence
  Description of Artificial Sequence: Synthetic oligonucleotide
uggaaaauauugugcacugucag

SEQ ID NO: 765 - RNA, 23 nt, Artificial Sequence
  Description of Artificial Sequence: Synthetic oligonucleotide
uucugcacagugucucuuuguca

SEQ ID NO: 766 - RNA, 23 nt, Artificial Sequence
  Description of Artificial Sequence: Synthetic oligonucleotide
uccuaggacacccauugaaaagu

SEQ ID NO: 767 - RNA, 23 nt, Artificial Sequence
  Description of Artificial Sequence: Synthetic oligonucleotide
acugucagaucuuggaaacggcc

SEQ ID NO: 768 - RNA, 23 nt, Artificial Sequence
  Description of Artificial Sequence: Synthetic oligonucleotide
uuugaacaccuuucucccccugg

SEQ ID NO: 769 - RNA, 23 nt, Artificial Sequence
  Description of Artificial Sequence: Synthetic oligonucleotide
accaaugucuugucgaugacuuu

SEQ ID NO: 770 - DNA, 21 bp, Artificial Sequence
  Description of Artificial Sequence: Synthetic oligonucleotide
  Description of Combined DNA/RNA Molecule: Synthetic oligonucleotide
uucaauggguguccuaggatt

SEQ ID NO: 771 - RNA, 19 nt, Artificial Sequence
  Description of Artificial Sequence: Synthetic oligonucleotide
uucaauggguguccuagga

SEQ ID NO: 772 - DNA, 21 bp, Artificial Sequence
  Description of Artificial Sequence: Synthetic oligonucleotide
  Description of Combined DNA/RNA Molecule: Synthetic oligonucleotide
acaacuggagggacaucgutt

SEQ ID NO: 773 - RNA, 19 nt, Artificial Sequence
  Description of Artificial Sequence: Synthetic oligonucleotide
acaacuggagggacaucgu

SEQ ID NO: 774 - DNA, 21 bp, Artificial Sequence
  Description of Artificial Sequence: Synthetic oligonucleotide
  Description of Combined DNA/RNA Molecule: Synthetic oligonucleotide
uccuaggacacccauugaatt

SEQ ID NO: 775 - RNA, 19 nt, Artificial Sequence
  Description of Artificial Sequence: Synthetic oligonucleotide
uccuaggacacccauugaa

SEQ ID NO: 776 - DNA, 21 bp, Artificial Sequence
  Description of Artificial Sequence: Synthetic oligonucleotide
  Description of Combined DNA/RNA Molecule: Synthetic oligonucleotide
acgaugucccuccaguugutt

SEQ ID NO: 777 - RNA, 19 nt, Artificial Sequence
  Description of Artificial Sequence: Synthetic oligonucleotide
acgaugucccuccaguugu

SEQ ID NO: 778 - RNA, 21 nt, Artificial Sequence
  Description of Artificial Sequence: Synthetic oligonucleotide
uccuaggaaccuuuuagaaau

SEQ ID NO: 779 - RNA, 21 nt, Artificial Sequence
  Description of Artificial Sequence: Synthetic oligonucleotide
gacuuucauccuggaaauaua

SEQ ID NO: 780 - RNA, 21 nt, Artificial Sequence
  Description of Artificial Sequence: Synthetic oligonucleotide
gaaugugaaagucaucgacaa

SEQ ID NO: 781 - RNA, 21 nt, Artificial Sequence
  Description of Artificial Sequence: Synthetic oligonucleotide
cauuggugaggaaaaauccuu

SEQ ID NO: 782 - RNA, 21 nt, Artificial Sequence
  Description of Artificial Sequence: Synthetic oligonucleotide
aucgacaagacauuggugaga

SEQ ID NO: 783 - RNA, 21 nt, Artificial Sequence
  Description of Artificial Sequence: Synthetic oligonucleotide
acauuggugaggaaaaauccu

SEQ ID NO: 784 - RNA, 21 nt, Artificial Sequence
  Description of Artificial Sequence: Synthetic oligonucleotide
gaaagucaucgacaagacauu

SEQ ID NO: 785 - RNA, 21 nt, Artificial Sequence
  Description of Artificial Sequence: Synthetic oligonucleotide
aaagucaucgacaagacauua

SEQ ID NO: 786 - RNA, 23 nt, Artificial Sequence
  Description of Artificial Sequence: Synthetic oligonucleotide
auuucuaaaagguuccuaggaca

SEQ ID NO: 787 - RNA, 23 nt, Artificial Sequence
  Description of Artificial Sequence: Synthetic oligonucleotide
uauauuuccaggaugaaagucca

SEQ ID NO: 788 - RNA, 23 nt, Artificial Sequence
  Description of Artificial Sequence: Synthetic oligonucleotide
uugucgaugacuuucacauucug

SEQ ID NO: 789 - RNA, 23 nt, Artificial Sequence
  Description of Artificial Sequence: Synthetic oligonucleotide
aaggauuuuuccucaccaauguc

SEQ ID NO: 790 - RNA, 23 nt, Artificial Sequence
  Description of Artificial Sequence: Synthetic oligonucleotide
ucucaccaaugucuugucgauga

SEQ ID NO: 791 - RNA, 23 nt, Artificial Sequence
  Description of Artificial Sequence: Synthetic oligonucleotide
aggauuuuuccucaccaaugucu

SEQ ID NO: 792 - RNA, 23 nt, Artificial Sequence
  Description of Artificial Sequence: Synthetic oligonucleotide
aaugucuugucgaugacuuucac

SEQ ID NO: 793 - RNA, 23 nt, Artificial Sequence
  Description of Artificial Sequence: Synthetic oligonucleotide
uaaugucuugucgaugacuuuca

SEQ ID NO: 794 - RNA, 21 nt, Artificial Sequence
  Description of Artificial Sequence: Synthetic oligonucleotide
auguauguuacuucuuagaga

SEQ ID NO: 795 - RNA, 23 nt, Artificial Sequence
  Description of Artificial Sequence: Synthetic oligonucleotide
ucucuaagaaguaacauacaucc

SEQ ID NO: 796 - RNA, 21 nt, Artificial Sequence
  Description of Artificial Sequence: Synthetic oligonucleotide
uguauguuacuucuuagagag

SEQ ID NO: 797 - RNA, 23 nt, Artificial Sequence
  Description of Artificial Sequence: Synthetic oligonucleotide
cucucuaagaaguaacauacauc

SEQ ID NO: 798 - RNA, 21 nt, Artificial Sequence
  Description of Artificial Sequence: Synthetic oligonucleotide
uaggauguauguuacuucuua

SEQ ID NO: 799 - RNA, 23 nt, Artificial Sequence
  Description of Artificial Sequence: Synthetic oligonucleotide
uaagaaguaacauacauccuaaa

SEQ ID NO: 800 - RNA, 21 nt, Artificial Sequence
  Description of Artificial Sequence: Synthetic oligonucleotide
uuaggauguauguuacuucuu

SEQ ID NO: 801 - RNA, 23 nt, Artificial Sequence
  Description of Artificial Sequence: Synthetic oligonucleotide
aagaaguaacauacauccuaaaa

SEQ ID NO: 802 - RNA, 21 nt, Artificial Sequence
  Description of Artificial Sequence: Synthetic oligonucleotide
agaaagguguucaagaugucc

SEQ ID NO: 803 - RNA, 23 nt, Artificial Sequence
  Description of Artificial Sequence: Synthetic oligonucleotide
ggacaucuugaacaccuuucucc

SEQ ID NO: 804 - RNA, 21 nt, Artificial Sequence
  Description of Artificial Sequence: Synthetic oligonucleotide
gaaagguguucaagauguccu

SEQ ID NO: 805 - RNA, 23 nt, Artificial Sequence
  Description of Artificial Sequence: Synthetic oligonucleotide
aggacaucuugaacaccuuucuc

SEQ ID NO: 806 - RNA, 21 nt, Artificial Sequence
  Description of Artificial Sequence: Synthetic oligonucleotide
ggggagaaagguguucaagau

SEQ ID NO: 807 - RNA, 23 nt, Artificial Sequence
  Description of Artificial Sequence: Synthetic oligonucleotide
aucuugaacaccuuucucccccu

SEQ ID NO: 808 - RNA, 21 nt, Artificial Sequence
  Description of Artificial Sequence: Synthetic oligonucleotide
gggggagaaagguguucaaga

SEQ ID NO: 809 - RNA, 23 nt, Artificial Sequence
  Description of Artificial Sequence: Synthetic oligonucleotide
ucuugaacaccuuucucccccug

SEQ ID NO: 810 - RNA, 21 nt, Artificial Sequence
  Description of Artificial Sequence: Synthetic oligonucleotide
agaaacuuuggcugauaauau

SEQ ID NO: 811 - RNA, 23 nt, Artificial Sequence
  Description of Artificial Sequence: Synthetic oligonucleotide
auauuaucagccaaaguuucuuc

SEQ ID NO: 812 - RNA, 21 nt, Artificial Sequence
  Description of Artificial Sequence: Synthetic oligonucleotide
gaaacuuuggcugauaauauu

SEQ ID NO: 813 - RNA, 23 nt, Artificial Sequence
  Description of Artificial Sequence: Synthetic oligonucleotide
aauauuaucagccaaaguuucuu

SEQ ID NO: 814 - RNA, 21 nt, Artificial Sequence
  Description of Artificial Sequence: Synthetic oligonucleotide
augaagaaacuuuggcugaua

SEQ ID NO: 815 - RNA, 23 nt, Artificial Sequence
  Description of Artificial Sequence: Synthetic oligonucleotide
uaucagccaaaguuucuucauca

SEQ ID NO: 816 - RNA, 21 nt, Artificial Sequence
  Description of Artificial Sequence: Synthetic oligonucleotide
gaugaagaaacuuuggcugau

SEQ ID NO: 817 - RNA, 23 nt, Artificial Sequence
  Description of Artificial Sequence: Synthetic oligonucleotide
aucagccaaaguuucuucaucau

SEQ ID NO: 818 - RNA, 21 nt, Artificial Sequence
  Description of Artificial Sequence: Synthetic oligonucleotide
aaggcacugauguucugaaag

SEQ ID NO: 819 - RNA, 23 nt, Artificial Sequence
  Description of Artificial Sequence: Synthetic oligonucleotide
cuuucagaacaucagugccuuuc

SEQ ID NO: 820 - RNA, 21 nt, Artificial Sequence
  Description of Artificial Sequence: Synthetic oligonucleotide
aggcacugauguucugaaagc

SEQ ID NO: 821 - RNA, 23 nt, Artificial Sequence
  Description of Artificial Sequence: Synthetic oligonucleotide
gcuuucagaacaucagugccuuu

SEQ ID NO: 822 - RNA, 21 nt, Artificial Sequence
  Description of Artificial Sequence: Synthetic oligonucleotide
cggaaaggcacugauguucug

SEQ ID NO: 823 - RNA, 23 nt, Artificial Sequence
  Description of Artificial Sequence: Synthetic oligonucleotide
cagaacaucagugccuuuccgca

SEQ ID NO: 824 - RNA, 21 nt, Artificial Sequence
  Description of Artificial Sequence: Synthetic oligonucleotide
gcggaaaggcacugauguucu

SEQ ID NO: 825 - RNA, 23 nt, Artificial Sequence
  Description of Artificial Sequence: Synthetic oligonucleotide
agaacaucagugccuuuccgcac

SEQ ID NO: 826 - RNA, 21 nt, Artificial Sequence
  Description of Artificial Sequence: Synthetic oligonucleotide
agaagacugacaucauugcca

SEQ ID NO: 827 - RNA, 23 nt, Artificial Sequence
  Description of Artificial Sequence: Synthetic oligonucleotide
uggcaaugaugucagucuucuca

SEQ ID NO: 828 - RNA, 21 nt, Artificial Sequence
  Description of Artificial Sequence: Synthetic oligonucleotide
gaagacugacaucauugccaa

SEQ ID NO: 829 - RNA, 23 nt, Artificial Sequence
  Description of Artificial Sequence: Synthetic oligonucleotide
uuggcaaugaugucagucuucuc

SEQ ID NO: 830 - RNA, 21 nt, Artificial Sequence
  Description of Artificial Sequence: Synthetic oligonucleotide
gcugagaagacugacaucauu

SEQ ID NO: 831 - RNA, 23 nt, Artificial Sequence
  Description of Artificial Sequence: Synthetic oligonucleotide
aaugaugucagucuucucagcca

SEQ ID NO: 832 - RNA, 21 nt, Artificial Sequence
  Description of Artificial Sequence: Synthetic oligonucleotide
ggcugagaagacugacaucau

SEQ ID NO: 833 - RNA, 23 nt, Artificial Sequence
  Description of Artificial Sequence: Synthetic oligonucleotide
augaugucagucuucucagccau

SEQ ID NO: 834 - RNA, 21 nt, Artificial Sequence
  Description of Artificial Sequence: Synthetic oligonucleotide
uaaugccugauucacaacuuu

SEQ ID NO: 835 - RNA, 23 nt, Artificial Sequence
  Description of Artificial Sequence: Synthetic oligonucleotide
aaaguugugaaucaggcauuacc

SEQ ID NO: 836 - RNA, 21 nt, Artificial Sequence
  Description of Artificial Sequence: Synthetic oligonucleotide
aaugccugauucacaacuuug

SEQ ID NO: 837 - RNA, 23 nt, Artificial Sequence
  Description of Artificial Sequence: Synthetic oligonucleotide
caaaguugugaaucaggcauuac

SEQ ID NO: 838 - RNA, 21 nt, Artificial Sequence
  Description of Artificial Sequence: Synthetic oligonucleotide
uugguaaugccugauucacaa

SEQ ID NO: 839 - RNA, 23 nt, Artificial Sequence
  Description of Artificial Sequence: Synthetic oligonucleotide
uugugaaucaggcauuaccaaca

SEQ ID NO: 840 - RNA, 21 nt, Artificial Sequence
  Description of Artificial Sequence: Synthetic oligonucleotide
guugguaaugccugauucaca

SEQ ID NO: 841 - RNA, 23 nt, Artificial Sequence
  Description of Artificial Sequence: Synthetic oligonucleotide
ugugaaucaggcauuaccaacac

SEQ ID NO: 842 - RNA, 21 nt, Artificial Sequence
  Description of Artificial Sequence: Synthetic oligonucleotide
uaucaaauggcugagaagacu

SEQ ID NO: 843 - RNA, 23 nt, Artificial Sequence
  Description of Artificial Sequence: Synthetic oligonucleotide
agucuucucagccauuugauauc

SEQ ID NO: 844 - RNA, 21 nt, Artificial Sequence
  Description of Artificial Sequence: Synthetic oligonucleotide
aucaaauggcugagaagacug

SEQ ID NO: 845 - RNA, 23 nt, Artificial Sequence
  Description of Artificial Sequence: Synthetic oligonucleotide
cagucuucucagccauuugauau

SEQ ID NO: 846 - RNA, 21 nt, Artificial Sequence
  Description of Artificial Sequence: Synthetic oligonucleotide
aagauaucaaauggcugagaa

SEQ ID NO: 847 - RNA, 23 nt, Artificial Sequence
  Description of Artificial Sequence: Synthetic oligonucleotide
uucucagccauuugauaucuucc

SEQ ID NO: 848 - RNA, 21 nt, Artificial Sequence
  Description of Artificial Sequence: Synthetic oligonucleotide
gaagauaucaaauggcugaga

SEQ ID NO: 849 - RNA, 23 nt, Artificial Sequence
  Description of Artificial Sequence: Synthetic oligonucleotide
ucucagccauuugauaucuuccc

SEQ ID NO: 850 - RNA, 21 nt, Artificial Sequence
  Description of Artificial Sequence: Synthetic oligonucleotide
ucugacagugcacaauauuuu

SEQ ID NO: 851 - RNA, 23 nt, Artificial Sequence
  Description of Artificial Sequence: Synthetic oligonucleotide
aaaauauugugcacugucagauc

SEQ ID NO: 852 - RNA, 21 nt, Artificial Sequence
  Description of Artificial Sequence: Synthetic oligonucleotide
cugacagugcacaauauuuuc

SEQ ID NO: 853 - RNA, 23 nt, Artificial Sequence
  Description of Artificial Sequence: Synthetic oligonucleotide
gaaaauauugugcacugucagau

SEQ ID NO: 854 - RNA, 21 nt, Artificial Sequence
  Description of Artificial Sequence: Synthetic oligonucleotide
aagaucugacagugcacaaua

SEQ ID NO: 855 - RNA, 23 nt, Artificial Sequence
  Description of Artificial Sequence: Synthetic oligonucleotide
uauugugcacugucagaucuugg

SEQ ID NO: 856 - RNA, 21 nt, Artificial Sequence
  Description of Artificial Sequence: Synthetic oligonucleotide
caagaucugacagugcacaau

SEQ ID NO: 857 - RNA, 23 nt, Artificial Sequence
  Description of Artificial Sequence: Synthetic oligonucleotide
auugugcacugucagaucuugga

SEQ ID NO: 858 - RNA, 21 nt, Artificial Sequence
  Description of Artificial Sequence: Synthetic oligonucleotide
acugauguucugaaagcucug

SEQ ID NO: 859 - RNA, 23 nt, Artificial Sequence
  Description of Artificial Sequence: Synthetic oligonucleotide
cagagcuuucagaacaucagugc

SEQ ID NO: 860 - RNA, 21 nt, Artificial Sequence
  Description of Artificial Sequence: Synthetic oligonucleotide
cugauguucugaaagcucugg

SEQ ID NO: 861 - RNA, 23 nt, Artificial Sequence
  Description of Artificial Sequence: Synthetic oligonucleotide
ccagagcuuucagaacaucagug

SEQ ID NO: 862 - RNA, 21 nt, Artificial Sequence
  Description of Artificial Sequence: Synthetic oligonucleotide
aggcacugauguucugaaagc

SEQ ID NO: 863 - RNA, 23 nt, Artificial Sequence
  Description of Artificial Sequence: Synthetic oligonucleotide
gcuuucagaacaucagugccuuu

SEQ ID NO: 864 - RNA, 21 nt, Artificial Sequence
  Description of Artificial Sequence: Synthetic oligonucleotide
aaggcacugauguucugaaag

SEQ ID NO: 865 - RNA, 23 nt, Artificial Sequence
  Description of Artificial Sequence: Synthetic oligonucleotide
cuuucagaacaucagugccuuuc

SEQ ID NO: 866 - RNA, 21 nt, Artificial Sequence
  Description of Artificial Sequence: Synthetic oligonucleotide
aacaacaugcuaaaucaguac

SEQ ID NO: 867 - RNA, 23 nt, Artificial Sequence
  Description of Artificial Sequence: Synthetic oligonucleotide
guacugauuuagcauguuguuca

SEQ ID NO: 868 - RNA, 21 nt, Artificial Sequence
  Description of Artificial Sequence: Synthetic oligonucleotide
acaacaugcuaaaucaguacu

SEQ ID NO: 869 - RNA, 23 nt, Artificial Sequence
  Description of Artificial Sequence: Synthetic oligonucleotide
aguacugauuuagcauguuguuc

SEQ ID NO: 870 - RNA, 21 nt, Artificial Sequence
  Description of Artificial Sequence: Synthetic oligonucleotide
uaugaacaacaugcuaaauca

SEQ ID NO: 871 - RNA, 23 nt, Artificial Sequence
  Description of Artificial Sequence: Synthetic oligonucleotide
ugauuuagcauguuguucauaau

SEQ ID NO: 872 - RNA, 21 nt, Artificial Sequence
  Description of Artificial Sequence: Synthetic oligonucleotide
uuaugaacaacaugcuaaauc

SEQ ID NO: 873 - RNA, 23 nt, Artificial Sequence
  Description of Artificial Sequence: Synthetic oligonucleotide
gauuuagcauguuguucauaauc

SEQ ID NO: 874 - RNA, 21 nt, Artificial Sequence
  Description of Artificial Sequence: Synthetic oligonucleotide
ucuuuagugucugaauauauc

SEQ ID NO: 875 - RNA, 23 nt, Artificial Sequence
  Description of Artificial Sequence: Synthetic oligonucleotide
gauauauucagacacuaaagaug

SEQ ID NO: 876 - RNA, 21 nt, Artificial Sequence
  Description of Artificial Sequence: Synthetic oligonucleotide
cuuuagugucugaauauaucc

SEQ ID NO: 877 - RNA, 23 nt, Artificial Sequence
  Description of Artificial Sequence: Synthetic oligonucleotide
ggauauauucagacacuaaagau

SEQ ID NO: 878 - RNA, 21 nt, Artificial Sequence
  Description of Artificial Sequence: Synthetic oligonucleotide
cacaucuuuagugucugaaua

SEQ ID NO: 879 - RNA, 23 nt, Artificial Sequence
  Description of Artificial Sequence: Synthetic oligonucleotide
uauucagacacuaaagaugugau

SEQ ID NO: 880 - RNA, 21 nt, Artificial Sequence
  Description of Artificial Sequence: Synthetic oligonucleotide
ucacaucuuuagugucugaau

SEQ ID NO: 881 - RNA, 23 nt, Artificial Sequence
  Description of Artificial Sequence: Synthetic oligonucleotide
auucagacacuaaagaugugauu

SEQ ID NO: 882 - RNA, 21 nt, Artificial Sequence
  Description of Artificial Sequence: Synthetic oligonucleotide
ugauacuucuuugaauguaga

SEQ ID NO: 883 - RNA, 23 nt, Artificial Sequence
  Description of Artificial Sequence: Synthetic oligonucleotide
ucuacauucaaagaaguaucacc

SEQ ID NO: 884 - RNA, 21 nt, Artificial Sequence
  Description of Artificial Sequence: Synthetic oligonucleotide
gauacuucuuugaauguagau

SEQ ID NO: 885 - RNA, 23 nt, Artificial Sequence
  Description of Artificial Sequence: Synthetic oligonucleotide
aucuacauucaaagaaguaucac

SEQ ID NO: 886 - RNA, 21 nt, Artificial Sequence
  Description of Artificial Sequence: Synthetic oligonucleotide
uuggugauacuucuuugaaug

SEQ ID NO: 887 - RNA, 23 nt, Artificial Sequence
  Description of Artificial Sequence: Synthetic oligonucleotide
cauucaaagaaguaucaccaauu

SEQ ID NO: 888 - RNA, 21 nt, Artificial Sequence
  Description of Artificial Sequence: Synthetic oligonucleotide
auuggugauacuucuuugaau

SEQ ID NO: 889 - RNA, 23 nt, Artificial Sequence
  Description of Artificial Sequence: Synthetic oligonucleotide
auucaaagaaguaucaccaauua

SEQ ID NO: 890 - RNA, 21 nt, Artificial Sequence
  Description of Artificial Sequence: Synthetic oligonucleotide
aauaaccugugaaaaugcucc

SEQ ID NO: 891 - RNA, 23 nt, Artificial Sequence
  Description of Artificial Sequence: Synthetic oligonucleotide
ggagcauuuucacagguuauugc

SEQ ID NO: 892 - RNA, 21 nt, Artificial Sequence
  Description of Artificial Sequence: Synthetic oligonucleotide
auaaccugugaaaaugcuccc

SEQ ID NO: 893 - RNA, 23 nt, Artificial Sequence
  Description of Artificial Sequence: Synthetic oligonucleotide
gggagcauuuucacagguuauug

SEQ ID NO: 894 - RNA, 21 nt, Artificial Sequence
  Description of Artificial Sequence: Synthetic oligonucleotide
uagcaauaaccugugaaaaug

SEQ ID NO: 895 - RNA, 23 nt, Artificial Sequence
  Description of Artificial Sequence: Synthetic oligonucleotide
cauuuucacagguuauugcuauc

SEQ ID NO: 896 - RNA, 21 nt, Artificial Sequence
  Description of Artificial Sequence: Synthetic oligonucleotide
auagcaauaaccugugaaaau

SEQ ID NO: 897 - RNA, 23 nt, Artificial Sequence
  Description of Artificial Sequence: Synthetic oligonucleotide
auuuucacagguuauugcuaucc

SEQ ID NO: 898 - RNA, 21 nt, Artificial Sequence
  Description of Artificial Sequence: Synthetic oligonucleotide
aaucacaucuuuagugucuga

SEQ ID NO: 899 - RNA, 23 nt, Artificial Sequence
  Description of Artificial Sequence: Synthetic oligonucleotide
ucagacacuaaagaugugauugg

SEQ ID NO: 900 - RNA, 21 nt, Artificial Sequence
  Description of Artificial Sequence: Synthetic oligonucleotide
aucacaucuuuagugucugaa

SEQ ID NO: 901 - RNA, 23 nt, Artificial Sequence
  Description of Artificial Sequence: Synthetic oligonucleotide
uucagacacuaaagaugugauug

SEQ ID NO: 902 - RNA, 21 nt, Artificial Sequence
  Description of Artificial Sequence: Synthetic oligonucleotide
uuccaaucacaucuuuagugu

SEQ ID NO: 903 - RNA, 23 nt, Artificial Sequence
  Description of Artificial Sequence: Synthetic oligonucleotide
acacuaaagaugugauuggaaau

SEQ ID NO: 904 - RNA, 21 nt, Artificial Sequence
  Description of Artificial Sequence: Synthetic oligonucleotide
uuuccaaucacaucuuuagug

SEQ ID NO: 905 - RNA, 23 nt, Artificial Sequence
  Description of Artificial Sequence: Synthetic oligonucleotide
cacuaaagaugugauuggaaauc

SEQ ID NO: 906 - RNA, 21 nt, Artificial Sequence
  Description of Artificial Sequence: Synthetic oligonucleotide
acgggcaugauguugaguucc

SEQ ID NO: 907 - RNA, 23 nt, Artificial Sequence
  Description of Artificial Sequence: Synthetic oligonucleotide
ggaacucaacaucaugcccguuc

SEQ ID NO: 908 - RNA, 21 nt, Artificial Sequence
  Description of Artificial Sequence: Synthetic oligonucleotide
cgggcaugauguugaguuccu

SEQ ID NO: 909 - RNA, 23 nt, Artificial Sequence
  Description of Artificial Sequence: Synthetic oligonucleotide
aggaacucaacaucaugcccguu

SEQ ID NO: 910 - RNA, 21 nt, Artificial Sequence
  Description of Artificial Sequence: Synthetic oligonucleotide
gggaacgggcaugauguugag

SEQ ID NO: 911 - RNA, 23 nt, Artificial Sequence
  Description of Artificial Sequence: Synthetic oligonucleotide
cucaacaucaugcccguucccag

SEQ ID NO: 912 - RNA, 21 nt, Artificial Sequence
  Description of Artificial Sequence: Synthetic oligonucleotide
ugggaacgggcaugauguuga

SEQ ID NO: 913 - RNA, 23 nt, Artificial Sequence
  Description of Artificial Sequence: Synthetic oligonucleotide
ucaacaucaugcccguucccagg

SEQ ID NO: 914 - RNA, 21 nt, Artificial Sequence
  Description of Artificial Sequence: Synthetic oligonucleotide
acuaaggugaaaagauaauga

SEQ ID NO: 915 - RNA, 23 nt, Artificial Sequence
  Description of Artificial Sequence: Synthetic oligonucleotide
ucauuaucuuuucaccuuagugu

SEQ ID NO: 916 - RNA, 21 nt, Artificial Sequence
  Description of Artificial Sequence: Synthetic oligonucleotide
cuaaggugaaaagauaaugau

SEQ ID NO: 917 - RNA, 23 nt, Artificial Sequence
  Description of Artificial Sequence: Synthetic oligonucleotide
aucauuaucuuuucaccuuagug

SEQ ID NO: 918 - RNA, 21 nt, Artificial Sequence
  Description of Artificial Sequence: Synthetic oligonucleotide
aaacacuaaggugaaaagaua

SEQ ID NO: 919 - RNA, 23 nt, Artificial Sequence
  Description of Artificial Sequence: Synthetic oligonucleotide
uaucuuuucaccuuaguguuugc

SEQ ID NO: 920 - RNA, 21 nt, Artificial Sequence
  Description of Artificial Sequence: Synthetic oligonucleotide
caaacacuaaggugaaaagau

SEQ ID NO: 921 - RNA, 23 nt, Artificial Sequence
  Description of Artificial Sequence: Synthetic oligonucleotide
aucuuuucaccuuaguguuugcu

SEQ ID NO: 922 - RNA, 21 nt, Artificial Sequence
  Description of Artificial Sequence: Synthetic oligonucleotide
agguagcacuggagagaauug

SEQ ID NO: 923 - RNA, 23 nt, Artificial Sequence
  Description of Artificial Sequence: Synthetic oligonucleotide
caauucucuccagugcuaccuuc

SEQ ID NO: 924 - RNA, 21 nt, Artificial Sequence
  Description of Artificial Sequence: Synthetic oligonucleotide
gguagcacuggagagaauugg

SEQ ID NO: 925 - RNA, 23 nt, Artificial Sequence
  Description of Artificial Sequence: Synthetic oligonucleotide
ccaauucucuccagugcuaccuu

SEQ ID NO: 926 - RNA, 21 nt, Artificial Sequence
  Description of Artificial Sequence: Synthetic oligonucleotide
gagaagguagcacuggagaga

SEQ ID NO: 927 - RNA, 23 nt, Artificial Sequence
  Description of Artificial Sequence: Synthetic oligonucleotide
ucucuccagugcuaccuucucaa

SEQ ID NO: 928 - RNA, 21 nt, Artificial Sequence
  Description of Artificial Sequence: Synthetic oligonucleotide
ugagaagguagcacuggagag

SEQ ID NO: 929 - RNA, 23 nt, Artificial Sequence
  Description of Artificial Sequence: Synthetic oligonucleotide
cucuccagugcuaccuucucaaa

SEQ ID NO: 930 - RNA, 21 nt, Artificial Sequence
  Description of Artificial Sequence: Synthetic oligonucleotide
aguggacuugcugcauaugug

SEQ ID NO: 931 - RNA, 23 nt, Artificial Sequence
  Description of Artificial Sequence: Synthetic oligonucleotide
cacauaugcagcaaguccacugu

SEQ ID NO: 932 - RNA, 21 nt, Artificial Sequence
  Description of Artificial Sequence: Synthetic oligonucleotide
guggacuugcugcauaugugg

SEQ ID NO: 933 - RNA, 23 nt, Artificial Sequence
  Description of Artificial Sequence: Synthetic oligonucleotide
ccacauaugcagcaaguccacug

SEQ ID NO: 934 - RNA, 21 nt, Artificial Sequence
  Description of Artificial Sequence: Synthetic oligonucleotide
cgacaguggacuugcugcaua

SEQ ID NO: 935 - RNA, 23 nt, Artificial Sequence
  Description of Artificial Sequence: Synthetic oligonucleotide
uaugcagcaaguccacugucguc

SEQ ID NO: 936 - RNA, 21 nt, Artificial Sequence
  Description of Artificial Sequence: Synthetic oligonucleotide
acgacaguggacuugcugcau

SEQ ID NO: 937 - RNA, 23 nt, Artificial Sequence
  Description of Artificial Sequence: Synthetic oligonucleotide
augcagcaaguccacugucgucu

SEQ ID NO: 938 - RNA, 21 nt, Artificial Sequence
  Description of Artificial Sequence: Synthetic oligonucleotide
aagguguucaagauguccucg

SEQ ID NO: 939 - RNA, 23 nt, Artificial Sequence
  Description of Artificial Sequence: Synthetic oligonucleotide
cgaggacaucuugaacaccuuuc

SEQ ID NO: 940 - RNA, 21 nt, Artificial Sequence
  Description of Artificial Sequence: Synthetic oligonucleotide
agguguucaagauguccucga

SEQ ID NO: 941 - RNA, 23 nt, Artificial Sequence
  Description of Artificial Sequence: Synthetic oligonucleotide
ucgaggacaucuugaacaccuuu

SEQ ID NO: 942 - RNA, 21 nt, Artificial Sequence
  Description of Artificial Sequence: Synthetic oligonucleotide
gagaaagguguucaagauguc

SEQ ID NO: 943 - RNA, 23 nt, Artificial Sequence
  Description of Artificial Sequence: Synthetic oligonucleotide
gacaucuugaacaccuuucuccc

SEQ ID NO: 944 - RNA, 21 nt, Artificial Sequence
  Description of Artificial Sequence: Synthetic oligonucleotide
ggagaaagguguucaagaugu

SEQ ID NO: 945 - RNA, 23 nt, Artificial Sequence
  Description of Artificial Sequence: Synthetic oligonucleotide
acaucuugaacaccuuucucccc

SEQ ID NO: 946 - RNA, 21 nt, Artificial Sequence
  Description of Artificial Sequence: Synthetic oligonucleotide
aaccgucuggaugaugugcgu

SEQ ID NO: 947 - RNA, 23 nt, Artificial Sequence
  Description of Artificial Sequence: Synthetic oligonucleotide
acgcacaucauccagacgguugc

SEQ ID NO: 948 - RNA, 21 nt, Artificial Sequence
  Description of Artificial Sequence: Synthetic oligonucleotide
accgucuggaugaugugcgua

SEQ ID NO: 949 - RNA, 23 nt, Artificial Sequence
  Description of Artificial Sequence: Synthetic oligonucleotide
uacgcacaucauccagacgguug

SEQ ID NO: 950 - RNA, 21 nt, Artificial Sequence
  Description of Artificial Sequence: Synthetic oligonucleotide
gggcaaccgucuggaugaugu

SEQ ID NO: 951 - RNA, 23 nt, Artificial Sequence
  Description of Artificial Sequence: Synthetic oligonucleotide
acaucauccagacgguugcccag

SEQ ID NO: 952 - RNA, 21 nt, Artificial Sequence
  Description of Artificial Sequence: Synthetic oligonucleotide
ugggcaaccgucuggaugaug

SEQ ID NO: 953 - RNA, 23 nt, Artificial Sequence
  Description of Artificial Sequence: Synthetic oligonucleotide
caucauccagacgguugcccagg

SEQ ID NO: 954 - RNA, 21 nt, Artificial Sequence
  Description of Artificial Sequence: Synthetic oligonucleotide
gaaacuuuggcugauaauauu

SEQ ID NO: 955 - RNA, 23 nt, Artificial Sequence
  Description of Artificial Sequence: Synthetic oligonucleotide
aauauuaucagccaaaguuucuu

SEQ ID NO: 956 - RNA, 21 nt, Artificial Sequence
  Description of Artificial Sequence: Synthetic oligonucleotide
aaacuuuggcugauaauauug

SEQ ID NO: 957 - RNA, 23 nt, Artificial Sequence
  Description of Artificial Sequence: Synthetic oligonucleotide
caauauuaucagccaaaguuucu

SEQ ID NO: 958 - RNA, 21 nt, Artificial Sequence
  Description of Artificial Sequence: Synthetic oligonucleotide
ugaagaaacuuuggcugauaa

SEQ ID NO: 959 - RNA, 23 nt, Artificial Sequence
  Description of Artificial Sequence: Synthetic oligonucleotide
uuaucagccaaaguuucuucauc

SEQ ID NO: 960 - RNA, 21 nt, Artificial Sequence
  Description of Artificial Sequence: Synthetic oligonucleotide
augaagaaacuuuggcugaua

SEQ ID NO: 961 - RNA, 23 nt, Artificial Sequence
  Description of Artificial Sequence: Synthetic oligonucleotide
uaucagccaaaguuucuucauca

SEQ ID NO: 962 - RNA, 21 nt, Artificial Sequence
  Description of Artificial Sequence: Synthetic oligonucleotide
aaagguguucaagauguccuc

SEQ ID NO: 963 - RNA, 23 nt, Artificial Sequence
  Description of Artificial Sequence: Synthetic oligonucleotide
gaggacaucuugaacaccuuucu

SEQ ID NO: 964 - RNA, 21 nt, Artificial Sequence
  Description of Artificial Sequence: Synthetic oligonucleotide
aagguguucaagauguccucg

SEQ ID NO: 965 - RNA, 23 nt, Artificial Sequence
  Description of Artificial Sequence: Synthetic oligonucleotide
cgaggacaucuugaacaccuuuc

SEQ ID NO: 966 - RNA, 21 nt, Artificial Sequence
  Description of Artificial Sequence: Synthetic oligonucleotide
ggagaaagguguucaagaugu

SEQ ID NO: 967 - RNA, 23 nt, Artificial Sequence
  Description of Artificial Sequence: Synthetic oligonucleotide
acaucuugaacaccuuucucccc

SEQ ID NO: 968 - RNA, 21 nt, Artificial Sequence
  Description of Artificial Sequence: Synthetic oligonucleotide
gggagaaagguguucaagaug

SEQ ID NO: 969 - RNA, 23 nt, Artificial Sequence
  Description of Artificial Sequence: Synthetic oligonucleotide
caucuugaacaccuuucuccccc

SEQ ID NO: 970 - RNA, 21 nt, Artificial Sequence
  Description of Artificial Sequence: Synthetic oligonucleotide
aaaucaguacuuccaaagucu

SEQ ID NO: 971 - RNA, 23 nt, Artificial Sequence
  Description of Artificial Sequence: Synthetic oligonucleotide
agacuuuggaaguacugauuuag

SEQ ID NO: 972 - RNA, 21 nt, Artificial Sequence
  Description of Artificial Sequence: Synthetic oligonucleotide
aaucaguacuuccaaagucua

SEQ ID NO: 973 - RNA, 23 nt, Artificial Sequence
  Description of Artificial Sequence: Synthetic oligonucleotide
uagacuuuggaaguacugauuua

SEQ ID NO: 974 - RNA, 21 nt, Artificial Sequence
  Description of Artificial Sequence: Synthetic oligonucleotide
ugcuaaaucaguacuuccaaa

SEQ ID NO: 975 - RNA, 23 nt, Artificial Sequence
  Description of Artificial Sequence: Synthetic oligonucleotide
uuuggaaguacugauuuagcaug

SEQ ID NO: 976 - RNA, 21 nt, Artificial Sequence
  Description of Artificial Sequence: Synthetic oligonucleotide
augcuaaaucaguacuuccaa

SEQ ID NO: 977 - RNA, 23 nt, Artificial Sequence
  Description of Artificial Sequence: Synthetic oligonucleotide
uuggaaguacugauuuagcaugu

SEQ ID NO: 978 - RNA, 21 nt, Artificial Sequence
  Description of Artificial Sequence: Synthetic oligonucleotide
acaucuuuagugucugaauau

SEQ ID NO: 979 - RNA, 23 nt, Artificial Sequence
  Description of Artificial Sequence: Synthetic oligonucleotide
auauucagacacuaaagauguga

SEQ ID NO: 980 - RNA, 21 nt, Artificial Sequence
  Description of Artificial Sequence: Synthetic oligonucleotide
caucuuuagugucugaauaua

SEQ ID NO: 981 - RNA, 23 nt, Artificial Sequence
  Description of Artificial Sequence: Synthetic oligonucleotide
uauauucagacacuaaagaugug

SEQ ID NO: 982 - RNA, 21 nt, Artificial Sequence
  Description of Artificial Sequence: Synthetic oligonucleotide
aaucacaucuuuagugucuga

SEQ ID NO: 983 - RNA, 23 nt, Artificial Sequence
  Description of Artificial Sequence: Synthetic oligonucleotide
ucagacacuaaagaugugauugg

SEQ ID NO: 984 - RNA, 21 nt, Artificial Sequence
  Description of Artificial Sequence: Synthetic oligonucleotide
caaucacaucuuuagugucug

SEQ ID NO: 985 - RNA, 23 nt, Artificial Sequence
  Description of Artificial Sequence: Synthetic oligonucleotide
cagacacuaaagaugugauugga

SEQ ID NO: 986 - RNA, 21 nt, Artificial Sequence
  Description of Artificial Sequence: Synthetic oligonucleotide
gcauguauuacuugacaaaga

SEQ ID NO: 987 - RNA, 23 nt, Artificial Sequence
  Description of Artificial Sequence: Synthetic oligonucleotide
ucuuugucaaguaauacaugcug

SEQ ID NO: 988 - RNA, 21 nt, Artificial Sequence
  Description of Artificial Sequence: Synthetic oligonucleotide
cauguauuacuugacaaagag

SEQ ID NO: 989 - RNA, 23 nt, Artificial Sequence
  Description of Artificial Sequence: Synthetic oligonucleotide
cucuuugucaaguaauacaugcu

SEQ ID NO: 990 - RNA, 21 nt, Artificial Sequence
  Description of Artificial Sequence: Synthetic oligonucleotide
uucagcauguauuacuugaca

SEQ ID NO: 991 - RNA, 23 nt, Artificial Sequence
  Description of Artificial Sequence: Synthetic oligonucleotide
ugucaaguaauacaugcugaaaa

SEQ ID NO: 992 - RNA, 21 nt, Artificial Sequence
  Description of Artificial Sequence: Synthetic oligonucleotide
uuucagcauguauuacuugac

SEQ ID NO: 993 - RNA, 23 nt, Artificial Sequence
  Description of Artificial Sequence: Synthetic oligonucleotide
gucaaguaauacaugcugaaaaa

SEQ ID NO: 994 - RNA, 21 nt, Artificial Sequence
  Description of Artificial Sequence: Synthetic oligonucleotide
auguuacuucuuagagagaaa

SEQ ID NO: 995 - RNA, 23 nt, Artificial Sequence
  Description of Artificial Sequence: Synthetic oligonucleotide
uuucucucuaagaaguaacauac

SEQ ID NO: 996 - RNA, 21 nt, Artificial Sequence
  Description of Artificial Sequence: Synthetic oligonucleotide
uguuacuucuuagagagaaau

SEQ ID NO: 997 - RNA, 23 nt, Artificial Sequence
  Description of Artificial Sequence: Synthetic oligonucleotide
auuucucucuaagaaguaacaua

SEQ ID NO: 998 - RNA, 21 nt, Artificial Sequence
  Description of Artificial Sequence: Synthetic oligonucleotide
auguauguuacuucuuagaga

SEQ ID NO: 999 - RNA, 23 nt, Artificial Sequence
  Description of Artificial Sequence: Synthetic oligonucleotide
ucucuaagaaguaacauacaucc

SEQ ID NO: 1000 - RNA, 21 nt, Artificial Sequence
  Description of Artificial Sequence: Synthetic oligonucleotide
gauguauguuacuucuuagag

SEQ ID NO: 1001 - RNA, 23 nt, Artificial Sequence
  Description of Artificial Sequence: Synthetic oligonucleotide
cucuaagaaguaacauacauccu

SEQ ID NO: 1002 - RNA, 21 nt, Artificial Sequence
  Description of Artificial Sequence: Synthetic oligonucleotide
acaacuuugagaagguagcac

SEQ ID NO: 1003 - RNA, 23 nt, Artificial Sequence
  Description of Artificial Sequence: Synthetic oligonucleotide
gugcuaccuucucaaaguuguga

SEQ ID NO: 1004 - RNA, 21 nt, Artificial Sequence
  Description of Artificial Sequence: Synthetic oligonucleotide
caacuuugagaagguagcacu

SEQ ID NO: 1005 - RNA, 23 nt, Artificial Sequence
  Description of Artificial Sequence: Synthetic oligonucleotide
agugcuaccuucucaaaguugug

SEQ ID NO: 1006 - RNA, 21 nt, Artificial Sequence
  Description of Artificial Sequence: Synthetic oligonucleotide
auucacaacuuugagaaggua

SEQ ID NO: 1007 - RNA, 23 nt, Artificial Sequence
  Description of Artificial Sequence: Synthetic oligonucleotide
uaccuucucaaaguugugaauca

SEQ ID NO: 1008 - RNA, 21 nt, Artificial Sequence
  Description of Artificial Sequence: Synthetic oligonucleotide
gauucacaacuuugagaaggu

SEQ ID NO: 1009 - RNA, 23 nt, Artificial Sequence
  Description of Artificial Sequence: Synthetic oligonucleotide
accuucucaaaguugugaaucag

SEQ ID NO: 1010 - RNA, 21 nt, Artificial Sequence
  Description of Artificial Sequence: Synthetic oligonucleotide
aacaugcuaaaucaguacuuc

SEQ ID NO: 1011 - RNA, 23 nt, Artificial Sequence
  Description of Artificial Sequence: Synthetic oligonucleotide
gaaguacugauuuagcauguugu

SEQ ID NO: 1012 - RNA, 21 nt, Artificial Sequence
  Description of Artificial Sequence: Synthetic oligonucleotide
acaugcuaaaucaguacuucc

SEQ ID NO: 1013 - RNA, 23 nt, Artificial Sequence
  Description of Artificial Sequence: Synthetic oligonucleotide
ggaaguacugauuuagcauguug

SEQ ID NO: 1014 - RNA, 21 nt, Artificial Sequence
  Description of Artificial Sequence: Synthetic oligonucleotide
gaacaacaugcuaaaucagua

SEQ ID NO: 1015 - RNA, 23 nt, Artificial Sequence
  Description of Artificial Sequence: Synthetic oligonucleotide
uacugauuuagcauguuguucau

SEQ ID NO: 1016 - RNA, 21 nt, Artificial Sequence
  Description of Artificial Sequence: Synthetic oligonucleotide
ugaacaacaugcuaaaucagu

SEQ ID NO: 1017 - RNA, 23 nt, Artificial Sequence
  Description of Artificial Sequence: Synthetic oligonucleotide
acugauuuagcauguuguucaua

SEQ ID NO: 1018 - RNA, 21 nt, Artificial Sequence
  Description of Artificial Sequence: Synthetic oligonucleotide
aaaccaguacuuuaucauuuu

SEQ ID NO: 1019 - RNA, 23 nt, Artificial Sequence
  Description of Artificial Sequence: Synthetic oligonucleotide
aaaaugauaaaguacugguuuca

SEQ ID NO: 1020 - RNA, 21 nt, Artificial Sequence
  Description of Artificial Sequence: Synthetic oligonucleotide
aaccaguacuuuaucauuuuc

SEQ ID NO: 1021 - RNA, 23 nt, Artificial Sequence
  Description of Artificial Sequence: Synthetic oligonucleotide
gaaaaugauaaaguacugguuuc

SEQ ID NO: 1022 - RNA, 21 nt, Artificial Sequence
  Description of Artificial Sequence: Synthetic oligonucleotide
uuugaaaccaguacuuuauca

SEQ ID NO: 1023 - RNA, 23 nt, Artificial Sequence
  Description of Artificial Sequence: Synthetic oligonucleotide
ugauaaaguacugguuucaaaau

SEQ ID NO: 1024 - RNA, 21 nt, Artificial Sequence
  Description of Artificial Sequence: Synthetic oligonucleotide
uuuugaaaccaguacuuuauc

SEQ ID NO: 1025 - RNA, 23 nt, Artificial Sequence
  Description of Artificial Sequence: Synthetic oligonucleotide
gauaaaguacugguuucaaaauu

SEQ ID NO: 1026 - RNA, 21 nt, Artificial Sequence
  Description of Artificial Sequence: Synthetic oligonucleotide
gagaagaugggcuacaaggcc

SEQ ID NO: 1027 - RNA, 23 nt, Artificial Sequence
  Description of Artificial Sequence: Synthetic oligonucleotide
ggccuuguagcccaucuucucug

SEQ ID NO: 1028 - RNA, 21 nt, Artificial Sequence
  Description of Artificial Sequence: Synthetic oligonucleotide
agaagaugggcuacaaggcca

SEQ ID NO: 1029 - RNA, 23 nt, Artificial Sequence
  Description of Artificial Sequence: Synthetic oligonucleotide
uggccuuguagcccaucuucucu

SEQ ID NO: 1030 - RNA, 21 nt, Artificial Sequence
  Description of Artificial Sequence: Synthetic oligonucleotide
ggcagagaagaugggcuacaa

SEQ ID NO: 1031 - RNA, 23 nt, Artificial Sequence
  Description of Artificial Sequence: Synthetic oligonucleotide
uuguagcccaucuucucugccug

SEQ ID NO: 1032 - RNA, 21 nt, Artificial Sequence
  Description of Artificial Sequence: Synthetic oligonucleotide
aggcagagaagaugggcuaca

SEQ ID NO: 1033 - RNA, 23 nt, Artificial Sequence
  Description of Artificial Sequence: Synthetic oligonucleotide
uguagcccaucuucucugccugc

SEQ ID NO: 1034 - RNA, 21 nt, Artificial Sequence
  Description of Artificial Sequence: Synthetic oligonucleotide
aacgggcaugauguugaguuc

SEQ ID NO: 1035 - RNA, 23 nt, Artificial Sequence
  Description of Artificial Sequence: Synthetic oligonucleotide
gaacucaacaucaugcccguucc

SEQ ID NO: 1036 - RNA, 21 nt, Artificial Sequence
  Description of Artificial Sequence: Synthetic oligonucleotide
acgggcaugauguugaguucc

SEQ ID NO: 1037 - RNA, 23 nt, Artificial Sequence
  Description of Artificial Sequence: Synthetic oligonucleotide
ggaacucaacaucaugcccguuc

SEQ ID NO: 1038 - RNA, 21 nt, Artificial Sequence
  Description of Artificial Sequence: Synthetic oligonucleotide
ugggaacgggcaugauguuga

SEQ ID NO: 1039 - RNA, 23 nt, Artificial Sequence
  Description of Artificial Sequence: Synthetic oligonucleotide
ucaacaucaugcccguucccagg

SEQ ID NO: 1040 - RNA, 21 nt, Artificial Sequence
  Description of Artificial Sequence: Synthetic oligonucleotide
cugggaacgggcaugauguug

SEQ ID NO: 1041 - RNA, 23 nt, Artificial Sequence
  Description of Artificial Sequence: Synthetic oligonucleotide
caacaucaugcccguucccaggg

SEQ ID NO: 1042 - RNA, 21 nt, Artificial Sequence
  Description of Artificial Sequence: Synthetic oligonucleotide
auguggcuaaagcaauagacc

SEQ ID NO: 1043 - RNA, 23 nt, Artificial Sequence
  Description of Artificial Sequence: Synthetic oligonucleotide
ggucuauugcuuuagccacauau

SEQ ID NO: 1044 - RNA, 21 nt, Artificial Sequence
  Description of Artificial Sequence: Synthetic oligonucleotide
uguggcuaaagcaauagaccc

SEQ ID NO: 1045 - RNA, 23 nt, Artificial Sequence
  Description of Artificial Sequence: Synthetic oligonucleotide
gggucuauugcuuuagccacaua

SEQ ID NO: 1046 - RNA, 21 nt, Artificial Sequence
  Description of Artificial Sequence: Synthetic oligonucleotide
gcauauguggcuaaagcaaua

SEQ ID NO: 1047 - RNA, 23 nt, Artificial Sequence
  Description of Artificial Sequence: Synthetic oligonucleotide
uauugcuuuagccacauaugcag

SEQ ID NO: 1048 - RNA, 21 nt, Artificial Sequence
  Description of Artificial Sequence: Synthetic oligonucleotide
ugcauauguggcuaaagcaau

SEQ ID NO: 1049 - RNA, 23 nt, Artificial Sequence
  Description of Artificial Sequence: Synthetic oligonucleotide
auugcuuuagccacauaugcagc

SEQ ID NO: 1050 - RNA, 21 nt, Artificial Sequence
  Description of Artificial Sequence: Synthetic oligonucleotide
aggaugcuccggaauguugcu

SEQ ID NO: 1051 - RNA, 23 nt, Artificial Sequence
  Description of Artificial Sequence: Synthetic oligonucleotide
agcaacauuccggagcauccuug

SEQ ID NO: 1052 - RNA, 21 nt, Artificial Sequence
  Description of Artificial Sequence: Synthetic oligonucleotide
ggaugcuccggaauguugcug

SEQ ID NO: 1053 - RNA, 23 nt, Artificial Sequence
  Description of Artificial Sequence: Synthetic oligonucleotide
cagcaacauuccggagcauccuu

SEQ ID NO: 1054 - RNA, 21 nt, Artificial Sequence
  Description of Artificial Sequence: Synthetic oligonucleotide
uccaaggaugcuccggaaugu

SEQ ID NO: 1055 - RNA, 23 nt, Artificial Sequence
  Description of Artificial Sequence: Synthetic oligonucleotide
acauuccggagcauccuuggaua

SEQ ID NO: 1056 - RNA, 21 nt, Artificial Sequence
  Description of Artificial Sequence: Synthetic oligonucleotide
auccaaggaugcuccggaaug

SEQ ID NO: 1057 - RNA, 23 nt, Artificial Sequence
  Description of Artificial Sequence: Synthetic oligonucleotide
cauuccggagcauccuuggauac

SEQ ID NO: 1058 - RNA, 21 nt, Artificial Sequence
  Description of Artificial Sequence: Synthetic oligonucleotide
ucacaucuuuagugucugaau

SEQ ID NO: 1059 - RNA, 23 nt, Artificial Sequence
  Description of Artificial Sequence: Synthetic oligonucleotide
auucagacacuaaagaugugauu

SEQ ID NO: 1060 - RNA, 21 nt, Artificial Sequence
  Description of Artificial Sequence: Synthetic oligonucleotide
cacaucuuuagugucugaaua

SEQ ID NO: 1061 - RNA, 23 nt, Artificial Sequence
  Description of Artificial Sequence: Synthetic oligonucleotide
uauucagacacuaaagaugugau

SEQ ID NO: 1062 - RNA, 21 nt, Artificial Sequence
  Description of Artificial Sequence: Synthetic oligonucleotide
ccaaucacaucuuuagugucu

SEQ ID NO: 1063 - RNA, 23 nt, Artificial Sequence
  Description of Artificial Sequence: Synthetic oligonucleotide
agacacuaaagaugugauuggaa

SEQ ID NO: 1064 - RNA, 21 nt, Artificial Sequence
  Description of Artificial Sequence: Synthetic oligonucleotide
uccaaucacaucuuuaguguc

SEQ ID NO: 1065 - RNA, 23 nt, Artificial Sequence
  Description of Artificial Sequence: Synthetic oligonucleotide
gacacuaaagaugugauuggaaa

SEQ ID NO: 1066 - RNA, 21 nt, Artificial Sequence
  Description of Artificial Sequence: Synthetic oligonucleotide
aaauguguuuagacaacguca

SEQ ID NO: 1067 - RNA, 23 nt, Artificial Sequence
  Description of Artificial Sequence: Synthetic oligonucleotide
ugacguugucuaaacacauuuuc

SEQ ID NO: 1068 - RNA, 21 nt, Artificial Sequence
  Description of Artificial Sequence: Synthetic oligonucleotide
aauguguuuagacaacgucau

SEQ ID NO: 1069 - RNA, 23 nt, Artificial Sequence
  Description of Artificial Sequence: Synthetic oligonucleotide
augacguugucuaaacacauuuu

SEQ ID NO: 1070 - RNA, 21 nt, Artificial Sequence
  Description of Artificial Sequence: Synthetic oligonucleotide
uugaaaauguguuuagacaac

SEQ ID NO: 1071 - RNA, 23 nt, Artificial Sequence
  Description of Artificial Sequence: Synthetic oligonucleotide
guugucuaaacacauuuucaaug

SEQ ID NO: 1072 - RNA, 21 nt, Artificial Sequence
  Description of Artificial Sequence: Synthetic oligonucleotide
auugaaaauguguuuagacaa

SEQ ID NO: 1073 - RNA, 23 nt, Artificial Sequence
  Description of Artificial Sequence: Synthetic oligonucleotide
uugucuaaacacauuuucaaugu

SEQ ID NO: 1074 - RNA, 21 nt, Artificial Sequence
  Description of Artificial Sequence: Synthetic oligonucleotide
uacuaaaggaagaauuccggu

SEQ ID NO: 1075 - RNA, 23 nt, Artificial Sequence
  Description of Artificial Sequence: Synthetic oligonucleotide
accggaauucuuccuuuaguauc

SEQ ID NO: 1076 - RNA, 21 nt, Artificial Sequence
  Description of Artificial Sequence: Synthetic oligonucleotide
acuaaaggaagaauuccgguu

SEQ ID NO: 1077 - RNA, 23 nt, Artificial Sequence
  Description of Artificial Sequence: Synthetic oligonucleotide
aaccggaauucuuccuuuaguau

SEQ ID NO: 1078 - RNA, 21 nt, Artificial Sequence
  Description of Artificial Sequence: Synthetic oligonucleotide
gagauacuaaaggaagaauuc

SEQ ID NO: 1079 - RNA, 23 nt, Artificial Sequence
  Description of Artificial Sequence: Synthetic oligonucleotide
gaauucuuccuuuaguaucucga

SEQ ID NO: 1080 - RNA, 21 nt, Artificial Sequence
  Description of Artificial Sequence: Synthetic oligonucleotide
cgagauacuaaaggaagaauu

SEQ ID NO: 1081 - RNA, 23 nt, Artificial Sequence
  Description of Artificial Sequence: Synthetic oligonucleotide
aauucuuccuuuaguaucucgag

SEQ ID NO: 1082 - RNA, 21 nt, Artificial Sequence
  Description of Artificial Sequence: Synthetic oligonucleotide
aacuuuggcugauaauauugc

SEQ ID NO: 1083 - RNA, 23 nt, Artificial Sequence
  Description of Artificial Sequence: Synthetic oligonucleotide
gcaauauuaucagccaaaguuuc

SEQ ID NO: 1084 - RNA, 21 nt, Artificial Sequence
  Description of Artificial Sequence: Synthetic oligonucleotide
acuuuggcugauaauauugca

SEQ ID NO: 1085 - RNA, 23 nt, Artificial Sequence
  Description of Artificial Sequence: Synthetic oligonucleotide
ugcaauauuaucagccaaaguuu

SEQ ID NO: 1086 - RNA, 21 nt, Artificial Sequence
  Description of Artificial Sequence: Synthetic oligonucleotide
aagaaacuuuggcugauaaua

SEQ ID NO: 1087 - RNA, 23 nt, Artificial Sequence
  Description of Artificial Sequence: Synthetic oligonucleotide
uauuaucagccaaaguuucuuca

SEQ ID NO: 1088 - RNA, 21 nt, Artificial Sequence
  Description of Artificial Sequence: Synthetic oligonucleotide
gaagaaacuuuggcugauaau

SEQ ID NO: 1089 - RNA, 23 nt, Artificial Sequence
  Description of Artificial Sequence: Synthetic oligonucleotide
auuaucagccaaaguuucuucau

SEQ ID NO: 1090 - RNA, 21 nt, Artificial Sequence
  Description of Artificial Sequence: Synthetic oligonucleotide
aaauggcugagaagacugaca

SEQ ID NO: 1091 - RNA, 23 nt, Artificial Sequence
  Description of Artificial Sequence: Synthetic oligonucleotide
ugucagucuucucagccauuuga

SEQ ID NO: 1092 - RNA, 21 nt, Artificial Sequence
  Description of Artificial Sequence: Synthetic oligonucleotide
aauggcugagaagacugacau

SEQ ID NO: 1093 - RNA, 23 nt, Artificial Sequence
  Description of Artificial Sequence: Synthetic oligonucleotide
augucagucuucucagccauuug

SEQ ID NO: 1094 - RNA, 21 nt, Artificial Sequence
  Description of Artificial Sequence: Synthetic oligonucleotide
uaucaaauggcugagaagacu

SEQ ID NO: 1095 - RNA, 23 nt, Artificial Sequence
  Description of Artificial Sequence: Synthetic oligonucleotide
agucuucucagccauuugauauc

SEQ ID NO: 1096 - RNA, 21 nt, Artificial Sequence
  Description of Artificial Sequence: Synthetic oligonucleotide
auaucaaauggcugagaagac

SEQ ID NO: 1097 - RNA, 23 nt, Artificial Sequence
  Description of Artificial Sequence: Synthetic oligonucleotide
gucuucucagccauuugauaucu

SEQ ID NO: 1098 - RNA, 21 nt, Artificial Sequence
  Description of Artificial Sequence: Synthetic oligonucleotide
gugguucuuaaauuguaagcu

SEQ ID NO: 1099 - RNA, 23 nt, Artificial Sequence
  Description of Artificial Sequence: Synthetic oligonucleotide
agcuuacaauuuaagaaccacug

SEQ ID NO: 1100 - RNA, 21 nt, Artificial Sequence
  Description of Artificial Sequence: Synthetic oligonucleotide
ugguucuuaaauuguaagcuc

SEQ ID NO: 1101 - RNA, 23 nt, Artificial Sequence
  Description of Artificial Sequence: Synthetic oligonucleotide
gagcuuacaauuuaagaaccacu

SEQ ID NO: 1102 - RNA, 21 nt, Artificial Sequence
  Description of Artificial Sequence: Synthetic oligonucleotide
aacagugguucuuaaauugua

SEQ ID NO: 1103 - RNA, 23 nt, Artificial Sequence
  Description of Artificial Sequence: Synthetic oligonucleotide
uacaauuuaagaaccacuguuuu

SEQ ID NO: 1104 - RNA, 21 nt, Artificial Sequence
  Description of Artificial Sequence: Synthetic oligonucleotide
aaacagugguucuuaaauugu

SEQ ID NO: 1105 - RNA, 23 nt, Artificial Sequence
  Description of Artificial Sequence: Synthetic oligonucleotide
acaauuuaagaaccacuguuuua

SEQ ID NO: 1106 - RNA, 21 nt, Artificial Sequence
  Description of Artificial Sequence: Synthetic oligonucleotide
aagucaucgacaagacauugg

SEQ ID NO: 1107 - RNA, 23 nt, Artificial Sequence
  Description of Artificial Sequence: Synthetic oligonucleotide
ccaaugucuugucgaugacuuuc

SEQ ID NO: 1108 - RNA, 21 nt, Artificial Sequence
  Description of Artificial Sequence: Synthetic oligonucleotide
agucaucgacaagacauuggu

SEQ ID NO: 1109 - RNA, 23 nt, Artificial Sequence
  Description of Artificial Sequence: Synthetic oligonucleotide
accaaugucuugucgaugacuuu

SEQ ID NO: 1110 - RNA, 21 nt, Artificial Sequence
  Description of Artificial Sequence: Synthetic oligonucleotide
gugaaagucaucgacaagaca

SEQ ID NO: 1111 - RNA, 23 nt, Artificial Sequence
  Description of Artificial Sequence: Synthetic oligonucleotide
ugucuugucgaugacuuucacau

SEQ ID NO: 1112 - RNA, 21 nt, Artificial Sequence
  Description of Artificial Sequence: Synthetic oligonucleotide
ugugaaagucaucgacaagac

SEQ ID NO: 1113 - RNA, 23 nt, Artificial Sequence
  Description of Artificial Sequence: Synthetic oligonucleotide
gucuugucgaugacuuucacauu

SEQ ID NO: 1114 - RNA, 21 nt, Artificial Sequence
  Description of Artificial Sequence: Synthetic oligonucleotide
gauaauauugcagcauuuucc

SEQ ID NO: 1115 - RNA, 23 nt, Artificial Sequence
  Description of Artificial Sequence: Synthetic oligonucleotide
ggaaaaugcugcaauauuaucag

SEQ ID NO: 1116 - RNA, 21 nt, Artificial Sequence
  Description of Artificial Sequence: Synthetic oligonucleotide
auaauauugcagcauuuucca

SEQ ID NO: 1117 - RNA, 23 nt, Artificial Sequence
  Description of Artificial Sequence: Synthetic oligonucleotide
uggaaaaugcugcaauauuauca

SEQ ID NO: 1118 - RNA, 21 nt, Artificial Sequence
  Description of Artificial Sequence: Synthetic oligonucleotide
ggcugauaauauugcagcauu

SEQ ID NO: 1119 - RNA, 23 nt, Artificial Sequence
  Description of Artificial Sequence: Synthetic oligonucleotide
aaugcugcaauauuaucagccaa

SEQ ID NO: 1120 - RNA, 21 nt, Artificial Sequence
  Description of Artificial Sequence: Synthetic oligonucleotide
uggcugauaauauugcagcau

SEQ ID NO: 1121 - RNA, 23 nt, Artificial Sequence
  Description of Artificial Sequence: Synthetic oligonucleotide
augcugcaauauuaucagccaaa

SEQ ID NO: 1122 - RNA, 21 nt, Artificial Sequence
  Description of Artificial Sequence: Synthetic oligonucleotide
gcuaauuuguaucaaugauua

SEQ ID NO: 1123 - RNA, 23 nt, Artificial Sequence
  Description of Artificial Sequence: Synthetic oligonucleotide
uaaucauugauacaaauuagccg

SEQ ID NO: 1124 - RNA, 21 nt, Artificial Sequence
  Description of Artificial Sequence: Synthetic oligonucleotide
cuaauuuguaucaaugauuau

SEQ ID NO: 1125 - RNA, 23 nt, Artificial Sequence
  Description of Artificial Sequence: Synthetic oligonucleotide
auaaucauugauacaaauuagcc

SEQ ID NO: 1126 - RNA, 21 nt, Artificial Sequence
  Description of Artificial Sequence: Synthetic oligonucleotide
cccggcuaauuuguaucaaug

SEQ ID NO: 1127 - RNA, 23 nt, Artificial Sequence
  Description of Artificial Sequence: Synthetic oligonucleotide
cauugauacaaauuagccggggg

SEQ ID NO: 1128 - RNA, 21 nt, Artificial Sequence
  Description of Artificial Sequence: Synthetic oligonucleotide
ccccggcuaauuuguaucaau

SEQ ID NO: 1129 - RNA, 23 nt, Artificial Sequence
  Description of Artificial Sequence: Synthetic oligonucleotide
auugauacaaauuagccggggga

SEQ ID NO: 1130 - RNA, 21 nt, Artificial Sequence
  Description of Artificial Sequence: Synthetic oligonucleotide
uaauuggugauacuucuuuga

SEQ ID NO: 1131 - RNA, 23 nt, Artificial Sequence
  Description of Artificial Sequence: Synthetic oligonucleotide
ucaaagaaguaucaccaauuacc

SEQ ID NO: 1132 - RNA, 21 nt, Artificial Sequence
  Description of Artificial Sequence: Synthetic oligonucleotide
aauuggugauacuucuuugaa

SEQ ID NO: 1133 - RNA, 23 nt, Artificial Sequence
  Description of Artificial Sequence: Synthetic oligonucleotide
uucaaagaaguaucaccaauuac

SEQ ID NO: 1134 - RNA, 21 nt, Artificial Sequence
  Description of Artificial Sequence: Synthetic oligonucleotide
gcgguaauuggugauacuucu

SEQ ID NO: 1135 - RNA, 23 nt, Artificial Sequence
  Description of Artificial Sequence: Synthetic oligonucleotide
agaaguaucaccaauuaccgcca

SEQ ID NO: 1136 - RNA, 21 nt, Artificial Sequence
  Description of Artificial Sequence: Synthetic oligonucleotide
ggcgguaauuggugauacuuc

SEQ ID NO: 1137 - RNA, 23 nt, Artificial Sequence
  Description of Artificial Sequence: Synthetic oligonucleotide
gaaguaucaccaauuaccgccac

SEQ ID NO: 1138 - RNA, 21 nt, Artificial Sequence
  Description of Artificial Sequence: Synthetic oligonucleotide
cagugguucuuaaauuguaag

SEQ ID NO: 1139 - RNA, 23 nt, Artificial Sequence
  Description of Artificial Sequence: Synthetic oligonucleotide
cuuacaauuuaagaaccacuguu

SEQ ID NO: 1140 - RNA, 21 nt, Artificial Sequence
  Description of Artificial Sequence: Synthetic oligonucleotide
agugguucuuaaauuguaagc

SEQ ID NO: 1141 - RNA, 23 nt, Artificial Sequence
  Description of Artificial Sequence: Synthetic oligonucleotide
gcuuacaauuuaagaaccacugu

SEQ ID NO: 1142 - RNA, 21 nt, Artificial Sequence
  Description of Artificial Sequence: Synthetic oligonucleotide
aaaacagugguucuuaaauug

SEQ ID NO: 1143 - RNA, 23 nt, Artificial Sequence
  Description of Artificial Sequence: Synthetic oligonucleotide
caauuuaagaaccacuguuuuaa

SEQ ID NO: 1144 - RNA, 21 nt, Artificial Sequence
  Description of Artificial Sequence: Synthetic oligonucleotide
uaaaacagugguucuuaaauu

SEQ ID NO: 1145 - RNA, 23 nt, Artificial Sequence
  Description of Artificial Sequence: Synthetic oligonucleotide
aauuuaagaaccacuguuuuaaa

SEQ ID NO: 1146 - RNA, 21 nt, Artificial Sequence
  Description of Artificial Sequence: Synthetic oligonucleotide
accuguauucuguuuacaugu

SEQ ID NO: 1147 - RNA, 23 nt, Artificial Sequence
  Description of Artificial Sequence: Synthetic oligonucleotide
acauguaaacagaauacagguua

SEQ ID NO: 1148 - RNA, 21 nt, Artificial Sequence
  Description of Artificial Sequence: Synthetic oligonucleotide
ccuguauucuguuuacauguc

SEQ ID NO: 1149 - RNA, 23 nt, Artificial Sequence
  Description of Artificial Sequence: Synthetic oligonucleotide
gacauguaaacagaauacagguu

SEQ ID NO: 1150 - RNA, 21 nt, Artificial Sequence
  Description of Artificial Sequence: Synthetic oligonucleotide
auuaaccuguauucuguuuac

SEQ ID NO: 1151 - RNA, 23 nt, Artificial Sequence
  Description of Artificial Sequence: Synthetic oligonucleotide
guaaacagaauacagguuaauaa

SEQ ID NO: 1152 - RNA, 21 nt, Artificial Sequence
  Description of Artificial Sequence: Synthetic oligonucleotide
uauuaaccuguauucuguuua

SEQ ID NO: 1153 - RNA, 23 nt, Artificial Sequence
  Description of Artificial Sequence: Synthetic oligonucleotide
uaaacagaauacagguuaauaaa

SEQ ID NO: 1154 - RNA, 21 nt, Artificial Sequence
  Description of Artificial Sequence: Synthetic oligonucleotide
aagaaacuuuggcugauaaua

SEQ ID NO: 1155 - RNA, 23 nt, Artificial Sequence
  Description of Artificial Sequence: Synthetic oligonucleotide
uauuaucagccaaaguuucuuca

SEQ ID NO: 1156 - RNA, 21 nt, Artificial Sequence
  Description of Artificial Sequence: Synthetic oligonucleotide
agaaacuuuggcugauaauau

SEQ ID NO: 1157 - RNA, 23 nt, Artificial Sequence
  Description of Artificial Sequence: Synthetic oligonucleotide
auauuaucagccaaaguuucuuc

SEQ ID NO: 1158 - RNA, 21 nt, Artificial Sequence
  Description of Artificial Sequence: Synthetic oligonucleotide
gaugaagaaacuuuggcugau

SEQ ID NO: 1159 - RNA, 23 nt, Artificial Sequence
  Description of Artificial Sequence: Synthetic oligonucleotide
aucagccaaaguuucuucaucau

SEQ ID NO: 1160 - RNA, 21 nt, Artificial Sequence
  Description of Artificial Sequence: Synthetic oligonucleotide
ugaugaagaaacuuuggcuga

SEQ ID NO: 1161 - RNA, 23 nt, Artificial Sequence
  Description of Artificial Sequence: Synthetic oligonucleotide
ucagccaaaguuucuucaucauu

SEQ ID NO: 1162 - RNA, 21 nt, Artificial Sequence
  Description of Artificial Sequence: Synthetic oligonucleotide
gaaagguguucaagauguccu

SEQ ID NO: 1163 - RNA, 23 nt, Artificial Sequence
  Description of Artificial Sequence: Synthetic oligonucleotide
aggacaucuugaacaccuuucuc

SEQ ID NO: 1164 - RNA, 21 nt, Artificial Sequence
  Description of Artificial Sequence: Synthetic oligonucleotide
aaagguguucaagauguccuc

SEQ ID NO: 1165 - RNA, 23 nt, Artificial Sequence
  Description of Artificial Sequence: Synthetic oligonucleotide
gaggacaucuugaacaccuuucu

SEQ ID NO: 1166 - RNA, 21 nt, Artificial Sequence
  Description of Artificial Sequence: Synthetic oligonucleotide
gggagaaagguguucaagaug

SEQ ID NO: 1167 - RNA, 23 nt, Artificial Sequence
  Description of Artificial Sequence: Synthetic oligonucleotide
caucuugaacaccuuucuccccc

SEQ ID NO: 1168 - RNA, 21 nt, Artificial Sequence
  Description of Artificial Sequence: Synthetic oligonucleotide
ggggagaaagguguucaagau

SEQ ID NO: 1169 - RNA, 23 nt, Artificial Sequence
  Description of Artificial Sequence: Synthetic oligonucleotide
aucuugaacaccuuucucccccu

SEQ ID NO: 1170 - RNA, 21 nt, Artificial Sequence
  Description of Artificial Sequence: Synthetic oligonucleotide
aucuuggugucgaaucauggg

SEQ ID NO: 1171 - RNA, 23 nt, Artificial Sequence
  Description of Artificial Sequence: Synthetic oligonucleotide
cccaugauucgacaccaagaucc

SEQ ID NO: 1172 - RNA, 21 nt, Artificial Sequence
  Description of Artificial Sequence: Synthetic oligonucleotide
ucuuggugucgaaucaugggg

SEQ ID NO: 1173 - RNA, 23 nt, Artificial Sequence
  Description of Artificial Sequence: Synthetic oligonucleotide
ccccaugauucgacaccaagauc

SEQ ID NO: 1174 - RNA, 21 nt, Artificial Sequence
  Description of Artificial Sequence: Synthetic oligonucleotide
ugggaucuuggugucgaauca

SEQ ID NO: 1175 - RNA, 23 nt, Artificial Sequence
  Description of Artificial Sequence: Synthetic oligonucleotide
ugauucgacaccaagaucccauu

SEQ ID NO: 1176 - RNA, 21 nt, Artificial Sequence
  Description of Artificial Sequence: Synthetic oligonucleotide
augggaucuuggugucgaauc

SEQ ID NO: 1177 - RNA, 23 nt, Artificial Sequence
  Description of Artificial Sequence: Synthetic oligonucleotide
gauucgacaccaagaucccauuc

SEQ ID NO: 1178 - RNA, 21 nt, Artificial Sequence
  Description of Artificial Sequence: Synthetic oligonucleotide
gcuacaaggccauauuuguga

SEQ ID NO: 1179 - RNA, 23 nt, Artificial Sequence
  Description of Artificial Sequence: Synthetic oligonucleotide
ucacaaauauggccuuguagccc

SEQ ID NO: 1180 - RNA, 21 nt, Artificial Sequence
  Description of Artificial Sequence: Synthetic oligonucleotide
cuacaaggccauauuugugac

SEQ ID NO: 1181 - RNA, 23 nt, Artificial Sequence
  Description of Artificial Sequence: Synthetic oligonucleotide
gucacaaauauggccuuguagcc

SEQ ID NO: 1182 - RNA, 21 nt, Artificial Sequence
  Description of Artificial Sequence: Synthetic oligonucleotide
augggcuacaaggccauauuu

SEQ ID NO: 1183 - RNA, 23 nt, Artificial Sequence
  Description of Artificial Sequence: Synthetic oligonucleotide
aaauauggccuuguagcccaucu

SEQ ID NO: 1184 - RNA, 21 nt, Artificial Sequence
  Description of Artificial Sequence: Synthetic oligonucleotide
gaugggcuacaaggccauauu

SEQ ID NO: 1185 - RNA, 23 nt, Artificial Sequence
  Description of Artificial Sequence: Synthetic oligonucleotide
aauauggccuuguagcccaucuu

SEQ ID NO: 1186 - RNA, 21 nt, Artificial Sequence
  Description of Artificial Sequence: Synthetic oligonucleotide
acuggagagaauuggaauggg

SEQ ID NO: 1187 - RNA, 23 nt, Artificial Sequence
  Description of Artificial Sequence: Synthetic oligonucleotide
cccauuccaauucucuccagugc

SEQ ID NO: 1188 - RNA, 21 nt, Artificial Sequence
  Description of Artificial Sequence: Synthetic oligonucleotide
cuggagagaauuggaaugggu

SEQ ID NO: 1189 - RNA, 23 nt, Artificial Sequence
  Description of Artificial Sequence: Synthetic oligonucleotide
acccauuccaauucucuccagug

SEQ ID NO: 1190 - RNA, 21 nt, Artificial Sequence
  Description of Artificial Sequence: Synthetic oligonucleotide
uagcacuggagagaauuggaa

SEQ ID NO: 1191 - RNA, 23 nt, Artificial Sequence
  Description of Artificial Sequence: Synthetic oligonucleotide
uuccaauucucuccagugcuacc

SEQ ID NO: 1192 - RNA, 21 nt, Artificial Sequence
  Description of Artificial Sequence: Synthetic oligonucleotide
guagcacuggagagaauugga

SEQ ID NO: 1193 - RNA, 23 nt, Artificial Sequence
  Description of Artificial Sequence: Synthetic oligonucleotide
uccaauucucuccagugcuaccu

SEQ ID NO: 1194 - RNA, 21 nt, Artificial Sequence
  Description of Artificial Sequence: Synthetic oligonucleotide
acaguggacacaccuuaccug

SEQ ID NO: 1195 - RNA, 23 nt, Artificial Sequence
  Description of Artificial Sequence: Synthetic oligonucleotide
cagguaagguguguccacuguca

SEQ ID NO: 1196 - RNA, 21 nt, Artificial Sequence
  Description of Artificial Sequence: Synthetic oligonucleotide
caguggacacaccuuaccugg

SEQ ID NO: 1197 - RNA, 23 nt, Artificial Sequence
  Description of Artificial Sequence: Synthetic oligonucleotide
ccagguaagguguguccacuguc

SEQ ID NO: 1198 - RNA, 21 nt, Artificial Sequence
  Description of Artificial Sequence: Synthetic oligonucleotide
ugugacaguggacacaccuua

SEQ ID NO: 1199 - RNA, 23 nt, Artificial Sequence
  Description of Artificial Sequence: Synthetic oligonucleotide
uaagguguguccacugucacaaa

SEQ ID NO: 1200 - RNA, 21 nt, Artificial Sequence
  Description of Artificial Sequence: Synthetic oligonucleotide
uugugacaguggacacaccuu

SEQ ID NO: 1201 - RNA, 23 nt, Artificial Sequence
  Description of Artificial Sequence: Synthetic oligonucleotide
aagguguguccacugucacaaau

SEQ ID NO: 1202 - RNA, 21 nt, Artificial Sequence
  Description of Artificial Sequence: Synthetic oligonucleotide
gaagacugacaucauugccaa

SEQ ID NO: 1203 - RNA, 23 nt, Artificial Sequence
  Description of Artificial Sequence: Synthetic oligonucleotide
uuggcaaugaugucagucuucuc

SEQ ID NO: 1204 - RNA, 21 nt, Artificial Sequence
  Description of Artificial Sequence: Synthetic oligonucleotide
aagacugacaucauugccaau

SEQ ID NO: 1205 - RNA, 23 nt, Artificial Sequence
  Description of Artificial Sequence: Synthetic oligonucleotide
auuggcaaugaugucagucuucu

SEQ ID NO: 1206 - RNA, 21 nt, Artificial Sequence
  Description of Artificial Sequence: Synthetic oligonucleotide
cugagaagacugacaucauug

SEQ ID NO: 1207 - RNA, 23 nt, Artificial Sequence
  Description of Artificial Sequence: Synthetic oligonucleotide
caaugaugucagucuucucagcc

SEQ ID NO: 1208 - RNA, 21 nt, Artificial Sequence
  Description of Artificial Sequence: Synthetic oligonucleotide
gcugagaagacugacaucauu

SEQ ID NO: 1209 - RNA, 23 nt, Artificial Sequence
  Description of Artificial Sequence: Synthetic oligonucleotide
aaugaugucagucuucucagcca

SEQ ID NO: 1210 - RNA, 21 nt, Artificial Sequence
  Description of Artificial Sequence: Synthetic oligonucleotide
gcucagguucaaaguguuggu

SEQ ID NO: 1211 - RNA, 23 nt, Artificial Sequence
  Description of Artificial Sequence: Synthetic oligonucleotide
accaacacuuugaaccugagcuu

SEQ ID NO: 1212 - RNA, 21 nt, Artificial Sequence
  Description of Artificial Sequence: Synthetic oligonucleotide
cucagguucaaaguguuggua

SEQ ID NO: 1213 - RNA, 23 nt, Artificial Sequence
  Description of Artificial Sequence: Synthetic oligonucleotide
uaccaacacuuugaaccugagcu

SEQ ID NO: 1214 - RNA, 21 nt, Artificial Sequence
  Description of Artificial Sequence: Synthetic oligonucleotide
guaagcucagguucaaagugu

SEQ ID NO: 1215 - RNA, 23 nt, Artificial Sequence
  Description of Artificial Sequence: Synthetic oligonucleotide
acacuuugaaccugagcuuacaa

SEQ ID NO: 1216 - RNA, 21 nt, Artificial Sequence
  Description of Artificial Sequence: Synthetic oligonucleotide
uguaagcucagguucaaagug

SEQ ID NO: 1217 - RNA, 23 nt, Artificial Sequence
  Description of Artificial Sequence: Synthetic oligonucleotide
cacuuugaaccugagcuuacaau

SEQ ID NO: 1218 - RNA, 21 nt, Artificial Sequence
  Description of Artificial Sequence: Synthetic oligonucleotide
auguauuacuugacaaagaga

SEQ ID NO: 1219 - RNA, 23 nt, Artificial Sequence
  Description of Artificial Sequence: Synthetic oligonucleotide
ucucuuugucaaguaauacaugc

SEQ ID NO: 1220 - RNA, 21 nt, Artificial Sequence
  Description of Artificial Sequence: Synthetic oligonucleotide
uguauuacuugacaaagagac

SEQ ID NO: 1221 - RNA, 23 nt, Artificial Sequence
  Description of Artificial Sequence: Synthetic oligonucleotide
gucucuuugucaaguaauacaug

SEQ ID NO: 1222 - RNA, 21 nt, Artificial Sequence
  Description of Artificial Sequence: Synthetic oligonucleotide
cagcauguauuacuugacaaa

SEQ ID NO: 1223 - RNA, 23 nt, Artificial Sequence
  Description of Artificial Sequence: Synthetic oligonucleotide
uuugucaaguaauacaugcugaa

SEQ ID NO: 1224 - RNA, 21 nt, Artificial Sequence
  Description of Artificial Sequence: Synthetic oligonucleotide
ucagcauguauuacuugacaa

SEQ ID NO: 1225 - RNA, 23 nt, Artificial Sequence
  Description of Artificial Sequence: Synthetic oligonucleotide
uugucaaguaauacaugcugaaa

SEQ ID NO: 1226 - RNA, 21 nt, Artificial Sequence
  Description of Artificial Sequence: Synthetic oligonucleotide
cugcaacuguauaucuacaag

SEQ ID NO: 1227 - RNA, 23 nt, Artificial Sequence
  Description of Artificial Sequence: Synthetic oligonucleotide
cuuguagauauacaguugcagcc

SEQ ID NO: 1228 - RNA, 21 nt, Artificial Sequence
  Description of Artificial Sequence: Synthetic oligonucleotide
ugcaacuguauaucuacaagg

SEQ ID NO: 1229 - RNA, 23 nt, Artificial Sequence
  Description of Artificial Sequence: Synthetic oligonucleotide
ccuuguagauauacaguugcagc

SEQ ID NO: 1230 - RNA, 21 nt, Artificial Sequence
  Description of Artificial Sequence: Synthetic oligonucleotide
uuggcugcaacuguauaucua

SEQ ID NO: 1231 - RNA, 23 nt, Artificial Sequence
  Description of Artificial Sequence: Synthetic oligonucleotide
uagauauacaguugcagccaacg

SEQ ID NO: 1232 - RNA, 21 nt, Artificial Sequence
  Description of Artificial Sequence: Synthetic oligonucleotide
guuggcugcaacuguauaucu

SEQ ID NO: 1233 - RNA, 23 nt, Artificial Sequence
  Description of Artificial Sequence: Synthetic oligonucleotide
agauauacaguugcagccaacga

SEQ ID NO: 1234 - RNA, 21 nt, Artificial Sequence
  Description of Artificial Sequence: Synthetic oligonucleotide
caaaugaugaagaaacuuugg

SEQ ID NO: 1235 - RNA, 23 nt, Artificial Sequence
  Description of Artificial Sequence: Synthetic oligonucleotide
ccaaaguuucuucaucauuugcc

SEQ ID NO: 1236 - RNA, 21 nt, Artificial Sequence
  Description of Artificial Sequence: Synthetic oligonucleotide
aaaugaugaagaaacuuuggc

SEQ ID NO: 1237 - RNA, 23 nt, Artificial Sequence
  Description of Artificial Sequence: Synthetic oligonucleotide
gccaaaguuucuucaucauuugc

SEQ ID NO: 1238 - RNA, 21 nt, Artificial Sequence
  Description of Artificial Sequence: Synthetic oligonucleotide
ggggcaaaugaugaagaaacu

SEQ ID NO: 1239 - RNA, 23 nt, Artificial Sequence
  Description of Artificial Sequence: Synthetic oligonucleotide
aguuucuucaucauuugccccag

SEQ ID NO: 1240 - RNA, 21 nt, Artificial Sequence
  Description of Artificial Sequence: Synthetic oligonucleotide
uggggcaaaugaugaagaaac

SEQ ID NO: 1241 - RNA, 23 nt, Artificial Sequence
  Description of Artificial Sequence: Synthetic oligonucleotide
guuucuucaucauuugccccaga

SEQ ID NO: 1242 - RNA, 21 nt, Artificial Sequence
  Description of Artificial Sequence: Synthetic oligonucleotide
caaagggugucguucuuuucc

SEQ ID NO: 1243 - RNA, 23 nt, Artificial Sequence
  Description of Artificial Sequence: Synthetic oligonucleotide
ggaaaagaacgacacccuuugua

SEQ ID NO: 1244 - RNA, 21 nt, Artificial Sequence
  Description of Artificial Sequence: Synthetic oligonucleotide
aaagggugucguucuuuucca

SEQ ID NO: 1245 - RNA, 23 nt, Artificial Sequence
  Description of Artificial Sequence: Synthetic oligonucleotide
uggaaaagaacgacacccuuugu

SEQ ID NO: 1246 - RNA, 21 nt, Artificial Sequence
  Description of Artificial Sequence: Synthetic oligonucleotide
aauacaaagggugucguucuu

SEQ ID NO: 1247 - RNA, 23 nt, Artificial Sequence
  Description of Artificial Sequence: Synthetic oligonucleotide
aagaacgacacccuuuguauuga

SEQ ID NO: 1248 - RNA, 21 nt, Artificial Sequence
  Description of Artificial Sequence: Synthetic oligonucleotide
caauacaaagggugucguucu

SEQ ID NO: 1249 - RNA, 23 nt, Artificial Sequence
  Description of Artificial Sequence: Synthetic oligonucleotide
agaacgacacccuuuguauugaa

SEQ ID NO: 1250 - RNA, 21 nt, Artificial Sequence
  Description of Artificial Sequence: Synthetic oligonucleotide
aaaggcacugauguucugaaa

SEQ ID NO: 1251 - RNA, 23 nt, Artificial Sequence
  Description of Artificial Sequence: Synthetic oligonucleotide
uuucagaacaucagugccuuucc

SEQ ID NO: 1252 - RNA, 21 nt, Artificial Sequence
  Description of Artificial Sequence: Synthetic oligonucleotide
aaggcacugauguucugaaag

SEQ ID NO: 1253 - RNA, 23 nt, Artificial Sequence
  Description of Artificial Sequence: Synthetic oligonucleotide
cuuucagaacaucagugccuuuc

SEQ ID NO: 1254 - RNA, 21 nt, Artificial Sequence
  Description of Artificial Sequence: Synthetic oligonucleotide
gcggaaaggcacugauguucu

SEQ ID NO: 1255 - RNA, 23 nt, Artificial Sequence
  Description of Artificial Sequence: Synthetic oligonucleotide
agaacaucagugccuuuccgcac

SEQ ID NO: 1256 - RNA, 21 nt, Artificial Sequence
  Description of Artificial Sequence: Synthetic oligonucleotide
ugcggaaaggcacugauguuc

SEQ ID NO: 1257 - RNA, 23 nt, Artificial Sequence
  Description of Artificial Sequence: Synthetic oligonucleotide
gaacaucagugccuuuccgcaca

SEQ ID NO: 1258 - RNA, 21 nt, Artificial Sequence
  Description of Artificial Sequence: Synthetic oligonucleotide
aaggaugcuccggaauguugc

SEQ ID NO: 1259 - RNA, 23 nt, Artificial Sequence
  Description of Artificial Sequence: Synthetic oligonucleotide
gcaacauuccggagcauccuugg

SEQ ID NO: 1260 - RNA, 21 nt, Artificial Sequence
  Description of Artificial Sequence: Synthetic oligonucleotide
aggaugcuccggaauguugcu

SEQ ID NO: 1261 - RNA, 23 nt, Artificial Sequence
  Description of Artificial Sequence: Synthetic oligonucleotide
agcaacauuccggagcauccuug

SEQ ID NO: 1262 - RNA, 21 nt, Artificial Sequence
  Description of Artificial Sequence: Synthetic oligonucleotide
auccaaggaugcuccggaaug

SEQ ID NO: 1263 - RNA, 23 nt, Artificial Sequence
  Description of Artificial Sequence: Synthetic oligonucleotide
cauuccggagcauccuuggauac

SEQ ID NO: 1264 - RNA, 21 nt, Artificial Sequence
  Description of Artificial Sequence: Synthetic oligonucleotide
uauccaaggaugcuccggaau

SEQ ID NO: 1265 - RNA, 23 nt, Artificial Sequence
  Description of Artificial Sequence: Synthetic oligonucleotide
auuccggagcauccuuggauaca

SEQ ID NO: 1266 - RNA, 21 nt, Artificial Sequence
  Description of Artificial Sequence: Synthetic oligonucleotide
aauggguggcgguaauuggug

SEQ ID NO: 1267 - RNA, 23 nt, Artificial Sequence
  Description of Artificial Sequence: Synthetic oligonucleotide
caccaauuaccgccacccauucc

SEQ ID NO: 1268 - RNA, 21 nt, Artificial Sequence
  Description of Artificial Sequence: Synthetic oligonucleotide
auggguggcgguaauugguga

SEQ ID NO: 1269 - RNA, 23 nt, Artificial Sequence
  Description of Artificial Sequence: Synthetic oligonucleotide
ucaccaauuaccgccacccauuc

SEQ ID NO: 1270 - RNA, 21 nt, Artificial Sequence
  Description of Artificial Sequence: Synthetic oligonucleotide
uuggaauggguggcgguaauu

SEQ ID NO: 1271 - RNA, 23 nt, Artificial Sequence
  Description of Artificial Sequence: Synthetic oligonucleotide
aauuaccgccacccauuccaauu

SEQ ID NO: 1272 - RNA, 21 nt, Artificial Sequence
  Description of Artificial Sequence: Synthetic oligonucleotide
auuggaauggguggcgguaau

SEQ ID NO: 1273 - RNA, 23 nt, Artificial Sequence
  Description of Artificial Sequence: Synthetic oligonucleotide
auuaccgccacccauuccaauuc

SEQ ID NO: 1274 - RNA, 21 nt, Artificial Sequence
  Description of Artificial Sequence: Synthetic oligonucleotide
ggaaaggcacugauguucuga

SEQ ID NO: 1275 - RNA, 23 nt, Artificial Sequence
  Description of Artificial Sequence: Synthetic oligonucleotide
ucagaacaucagugccuuuccgc

SEQ ID NO: 1276 - RNA, 21 nt, Artificial Sequence
  Description of Artificial Sequence: Synthetic oligonucleotide
gaaaggcacugauguucugaa

SEQ ID NO: 1277 - RNA, 23 nt, Artificial Sequence
  Description of Artificial Sequence: Synthetic oligonucleotide
uucagaacaucagugccuuuccg

SEQ ID NO: 1278 - RNA, 21 nt, Artificial Sequence
  Description of Artificial Sequence: Synthetic oligonucleotide
gugcggaaaggcacugauguu

SEQ ID NO: 1279 - RNA, 23 nt, Artificial Sequence
  Description of Artificial Sequence: Synthetic oligonucleotide
aacaucagugccuuuccgcacac

SEQ ID NO: 1280 - RNA, 21 nt, Artificial Sequence
  Description of Artificial Sequence: Synthetic oligonucleotide
ugugcggaaaggcacugaugu

SEQ ID NO: 1281 - RNA, 23 nt, Artificial Sequence
  Description of Artificial Sequence: Synthetic oligonucleotide
acaucagugccuuuccgcacacc

SEQ ID NO: 1282 - RNA, 21 nt, Artificial Sequence
  Description of Artificial Sequence: Synthetic oligonucleotide
aauuguaagcucagguucaaa

SEQ ID NO: 1283 - RNA, 23 nt, Artificial Sequence
  Description of Artificial Sequence: Synthetic oligonucleotide
uuugaaccugagcuuacaauuua

SEQ ID NO: 1284 - RNA, 21 nt, Artificial Sequence
  Description of Artificial Sequence: Synthetic oligonucleotide
auuguaagcucagguucaaag

SEQ ID NO: 1285 - RNA, 23 nt, Artificial Sequence
  Description of Artificial Sequence: Synthetic oligonucleotide
cuuugaaccugagcuuacaauuu

SEQ ID NO: 1286 - RNA, 21 nt, Artificial Sequence
  Description of Artificial Sequence: Synthetic oligonucleotide
cuuaaauuguaagcucagguu

SEQ ID NO: 1287 - RNA, 23 nt, Artificial Sequence
  Description of Artificial Sequence: Synthetic oligonucleotide
aaccugagcuuacaauuuaagaa

SEQ ID NO: 1288 - RNA, 21 nt, Artificial Sequence
  Description of Artificial Sequence: Synthetic oligonucleotide
ucuuaaauuguaagcucaggu

SEQ ID NO: 1289 - RNA, 23 nt, Artificial Sequence
  Description of Artificial Sequence: Synthetic oligonucleotide
accugagcuuacaauuuaagaac

SEQ ID NO: 1290 - RNA, 21 nt, Artificial Sequence
  Description of Artificial Sequence: Synthetic oligonucleotide
gcaaacacuaaggugaaaaga

SEQ ID NO: 1291 - RNA, 23 nt, Artificial Sequence
  Description of Artificial Sequence: Synthetic oligonucleotide
ucuuuucaccuuaguguuugcua

SEQ ID NO: 1292 - RNA, 21 nt, Artificial Sequence
  Description of Artificial Sequence: Synthetic oligonucleotide
caaacacuaaggugaaaagau

SEQ ID NO: 1293 - RNA, 23 nt, Artificial Sequence
  Description of Artificial Sequence: Synthetic oligonucleotide
aucuuuucaccuuaguguuugcu

SEQ ID NO: 1294 - RNA, 21 nt, Artificial Sequence
  Description of Artificial Sequence: Synthetic oligonucleotide
gguagcaaacacuaaggugaa

SEQ ID NO: 1295 - RNA, 23 nt, Artificial Sequence
  Description of Artificial Sequence: Synthetic oligonucleotide
uucaccuuaguguuugcuaccuc

SEQ ID NO: 1296 - RNA, 21 nt, Artificial Sequence
  Description of Artificial Sequence: Synthetic oligonucleotide
agguagcaaacacuaagguga

SEQ ID NO: 1297 - RNA, 23 nt, Artificial Sequence
  Description of Artificial Sequence: Synthetic oligonucleotide
ucaccuuaguguuugcuaccucc

SEQ ID NO: 1298 - RNA, 21 nt, Artificial Sequence
  Description of Artificial Sequence: Synthetic oligonucleotide
agguagcaaacacuaagguga

SEQ ID NO: 1299 - RNA, 23 nt, Artificial Sequence
  Description of Artificial Sequence: Synthetic oligonucleotide
ucaccuuaguguuugcuaccucc

SEQ ID NO: 1300 - RNA, 21 nt, Artificial Sequence
  Description of Artificial Sequence: Synthetic oligonucleotide
gguagcaaacacuaaggugaa

SEQ ID NO: 1301 - RNA, 23 nt, Artificial Sequence
  Description of Artificial Sequence: Synthetic oligonucleotide
uucaccuuaguguuugcuaccuc

SEQ ID NO: 1302 - RNA, 21 nt, Artificial Sequence
  Description of Artificial Sequence: Synthetic oligonucleotide
uuggagguagcaaacacuaag

SEQ ID NO: 1303 - RNA, 23 nt, Artificial Sequence
  Description of Artificial Sequence: Synthetic oligonucleotide
cuuaguguuugcuaccuccaauu

SEQ ID NO: 1304 - RNA, 21 nt, Artificial Sequence
  Description of Artificial Sequence: Synthetic oligonucleotide
auuggagguagcaaacacuaa

SEQ ID NO: 1305 - RNA, 23 nt, Artificial Sequence
  Description of Artificial Sequence: Synthetic oligonucleotide
uuaguguuugcuaccuccaauuu

SEQ ID NO: 1306 - RNA, 21 nt, Artificial Sequence
  Description of Artificial Sequence: Synthetic oligonucleotide
uaaagugcuguauccuuuagu

SEQ ID NO: 1307 - RNA, 23 nt, Artificial Sequence
  Description of Artificial Sequence: Synthetic oligonucleotide
acuaaaggauacagcacuuuagc

SEQ ID NO: 1308 - RNA, 21 nt, Artificial Sequence
  Description of Artificial Sequence: Synthetic oligonucleotide
aaagugcuguauccuuuagua

SEQ ID NO: 1309 - RNA, 23 nt, Artificial Sequence
  Description of Artificial Sequence: Synthetic oligonucleotide
uacuaaaggauacagcacuuuag

SEQ ID NO: 1310 - RNA, 21 nt, Artificial Sequence
  Description of Artificial Sequence: Synthetic oligonucleotide
aggcuaaagugcuguauccuu

SEQ ID NO: 1311 - RNA, 23 nt, Artificial Sequence
  Description of Artificial Sequence: Synthetic oligonucleotide
aaggauacagcacuuuagccugc

SEQ ID NO: 1312 - RNA, 21 nt, Artificial Sequence
  Description of Artificial Sequence: Synthetic oligonucleotide
caggcuaaagugcuguauccu

SEQ ID NO: 1313 - RNA, 23 nt, Artificial Sequence
  Description of Artificial Sequence: Synthetic oligonucleotide
aggauacagcacuuuagccugcc

SEQ ID NO: 1314 - RNA, 21 nt, Artificial Sequence
  Description of Artificial Sequence: Synthetic oligonucleotide
aagacauuggugaggaaaaau

SEQ ID NO: 1315 - RNA, 23 nt, Artificial Sequence
  Description of Artificial Sequence: Synthetic oligonucleotide
auuuuuccucaccaaugucuugu

SEQ ID NO: 1316 - RNA, 21 nt, Artificial Sequence
  Description of Artificial Sequence: Synthetic oligonucleotide
agacauuggugaggaaaaauc

SEQ ID NO: 1317 - RNA, 23 nt, Artificial Sequence
  Description of Artificial Sequence: Synthetic oligonucleotide
gauuuuuccucaccaaugucuug

SEQ ID NO: 1318 - RNA, 21 nt, Artificial Sequence
  Description of Artificial Sequence: Synthetic oligonucleotide
cgacaagacauuggugaggaa

SEQ ID NO: 1319 - RNA, 23 nt, Artificial Sequence
  Description of Artificial Sequence: Synthetic oligonucleotide
uuccucaccaaugucuugucgau

SEQ ID NO: 1320 - RNA, 21 nt, Artificial Sequence
  Description of Artificial Sequence: Synthetic oligonucleotide
ucgacaagacauuggugagga

SEQ ID NO: 1321 - RNA, 23 nt, Artificial Sequence
  Description of Artificial Sequence: Synthetic oligonucleotide
uccucaccaaugucuugucgaug

SEQ ID NO: 1322 - RNA, 21 nt, Artificial Sequence
  Description of Artificial Sequence: Synthetic oligonucleotide
aagauguccucgagauacuaa

SEQ ID NO: 1323 - RNA, 23 nt, Artificial Sequence
  Description of Artificial Sequence: Synthetic oligonucleotide
uuaguaucucgaggacaucuuga

SEQ ID NO: 1324 - RNA, 21 nt, Artificial Sequence
  Description of Artificial Sequence: Synthetic oligonucleotide
agauguccucgagauacuaaa

SEQ ID NO: 1325 - RNA, 23 nt, Artificial Sequence
  Description of Artificial Sequence: Synthetic oligonucleotide
uuuaguaucucgaggacaucuug

SEQ ID NO: 1326 - RNA, 21 nt, Artificial Sequence
  Description of Artificial Sequence: Synthetic oligonucleotide
guucaagauguccucgagaua

SEQ ID NO: 1327 - RNA, 23 nt, Artificial Sequence
  Description of Artificial Sequence: Synthetic oligonucleotide
uaucucgaggacaucuugaacac

SEQ ID NO: 1328 - RNA, 21 nt, Artificial Sequence
  Description of Artificial Sequence: Synthetic oligonucleotide
uguucaagauguccucgagau

SEQ ID NO: 1329 - RNA, 23 nt, Artificial Sequence
  Description of Artificial Sequence: Synthetic oligonucleotide
aucucgaggacaucuugaacacc

SEQ ID NO: 1330 - RNA, 21 nt, Artificial Sequence
  Description of Artificial Sequence: Synthetic oligonucleotide
gagaaagguguucaagauguc

SEQ ID NO: 1331 - RNA, 23 nt, Artificial Sequence
  Description of Artificial Sequence: Synthetic oligonucleotide
gacaucuugaacaccuuucuccc

SEQ ID NO: 1332 - RNA, 21 nt, Artificial Sequence
  Description of Artificial Sequence: Synthetic oligonucleotide
agaaagguguucaagaugucc

SEQ ID NO: 1333 - RNA, 23 nt, Artificial Sequence
  Description of Artificial Sequence: Synthetic oligonucleotide
ggacaucuugaacaccuuucucc

SEQ ID NO: 1334 - RNA, 21 nt, Artificial Sequence
  Description of Artificial Sequence: Synthetic oligonucleotide
gggggagaaagguguucaaga

SEQ ID NO: 1335 - RNA, 23 nt, Artificial Sequence
  Description of Artificial Sequence: Synthetic oligonucleotide
ucuugaacaccuuucucccccug

SEQ ID NO: 1336 - RNA, 21 nt, Artificial Sequence
  Description of Artificial Sequence: Synthetic oligonucleotide
agggggagaaagguguucaag

SEQ ID NO: 1337 - RNA, 23 nt, Artificial Sequence
  Description of Artificial Sequence: Synthetic oligonucleotide
cuugaacaccuuucucccccugg

SEQ ID NO: 1338 - RNA, 21 nt, Artificial Sequence
  Description of Artificial Sequence: Synthetic oligonucleotide
gcugggaagauaucaaauggc

SEQ ID NO: 1339 - RNA, 23 nt, Artificial Sequence
  Description of Artificial Sequence: Synthetic oligonucleotide
gccauuugauaucuucccagcug

SEQ ID NO: 1340 - RNA, 21 nt, Artificial Sequence
  Description of Artificial Sequence: Synthetic oligonucleotide
cugggaagauaucaaauggcu

SEQ ID NO: 1341 - RNA, 23 nt, Artificial Sequence
  Description of Artificial Sequence: Synthetic oligonucleotide
agccauuugauaucuucccagcu

SEQ ID NO: 1342 - RNA, 21 nt, Artificial Sequence
  Description of Artificial Sequence: Synthetic oligonucleotide
aucagcugggaagauaucaaa

SEQ ID NO: 1343 - RNA, 23 nt, Artificial Sequence
  Description of Artificial Sequence: Synthetic oligonucleotide
uuugauaucuucccagcugauag

SEQ ID NO: 1344 - RNA, 21 nt, Artificial Sequence
  Description of Artificial Sequence: Synthetic oligonucleotide
uaucagcugggaagauaucaa

SEQ ID NO: 1345 - RNA, 23 nt, Artificial Sequence
  Description of Artificial Sequence: Synthetic oligonucleotide
uugauaucuucccagcugauaga

SEQ ID NO: 1346 - RNA, 21 nt, Artificial Sequence
  Description of Artificial Sequence: Synthetic oligonucleotide
ucugucgacuucuguuuuagg

SEQ ID NO: 1347 - RNA, 23 nt, Artificial Sequence
  Description of Artificial Sequence: Synthetic oligonucleotide
ccuaaaacagaagucgacagauc

SEQ ID NO: 1348 - RNA, 21 nt, Artificial Sequence
  Description of Artificial Sequence: Synthetic oligonucleotide
cugucgacuucuguuuuagga

SEQ ID NO: 1349 - RNA, 23 nt, Artificial Sequence
  Description of Artificial Sequence: Synthetic oligonucleotide
uccuaaaacagaagucgacagau

SEQ ID NO: 1350 - RNA, 21 nt, Artificial Sequence
  Description of Artificial Sequence: Synthetic oligonucleotide
cagaucugucgacuucuguuu

SEQ ID NO: 1351 - RNA, 23 nt, Artificial Sequence
  Description of Artificial Sequence: Synthetic oligonucleotide
aaacagaagucgacagaucuguu

SEQ ID NO: 1352 - RNA, 21 nt, Artificial Sequence
  Description of Artificial Sequence: Synthetic oligonucleotide
acagaucugucgacuucuguu

SEQ ID NO: 1353 - RNA, 23 nt, Artificial Sequence
  Description of Artificial Sequence: Synthetic oligonucleotide
aacagaagucgacagaucuguuu

SEQ ID NO: 1354 - RNA, 21 nt, Artificial Sequence
  Description of Artificial Sequence: Synthetic oligonucleotide
uacuucuuugaauguagauuu

SEQ ID NO: 1355 - RNA, 23 nt, Artificial Sequence
  Description of Artificial Sequence: Synthetic oligonucleotide
aaaucuacauucaaagaaguauc

SEQ ID NO: 1356 - RNA, 21 nt, Artificial Sequence
  Description of Artificial Sequence: Synthetic oligonucleotide
acuucuuugaauguagauuuc

SEQ ID NO: 1357 - RNA, 23 nt, Artificial Sequence
  Description of Artificial Sequence: Synthetic oligonucleotide
gaaaucuacauucaaagaaguau

SEQ ID NO: 1358 - RNA, 21 nt, Artificial Sequence
  Description of Artificial Sequence: Synthetic oligonucleotide
gugauacuucuuugaauguag

SEQ ID NO: 1359 - RNA, 23 nt, Artificial Sequence
  Description of Artificial Sequence: Synthetic oligonucleotide
cuacauucaaagaaguaucacca

SEQ ID NO: 1360 - RNA, 21 nt, Artificial Sequence
  Description of Artificial Sequence: Synthetic oligonucleotide
ggugauacuucuuugaaugua

SEQ ID NO: 1361 - RNA, 23 nt, Artificial Sequence
  Description of Artificial Sequence: Synthetic oligonucleotide
uacauucaaagaaguaucaccaa

SEQ ID NO: 1362 - RNA, 21 nt, Artificial Sequence
  Description of Artificial Sequence: Synthetic oligonucleotide
ugggaagauaucaaauggcug

SEQ ID NO: 1363 - RNA, 23 nt, Artificial Sequence
  Description of Artificial Sequence: Synthetic oligonucleotide
cagccauuugauaucuucccagc

SEQ ID NO: 1364 - RNA, 21 nt, Artificial Sequence
  Description of Artificial Sequence: Synthetic oligonucleotide
gggaagauaucaaauggcuga

SEQ ID NO: 1365 - RNA, 23 nt, Artificial Sequence
  Description of Artificial Sequence: Synthetic oligonucleotide
ucagccauuugauaucuucccag

SEQ ID NO: 1366 - RNA, 21 nt, Artificial Sequence
  Description of Artificial Sequence: Synthetic oligonucleotide
cagcugggaagauaucaaaug

SEQ ID NO: 1367 - RNA, 23 nt, Artificial Sequence
  Description of Artificial Sequence: Synthetic oligonucleotide
cauuugauaucuucccagcugau

SEQ ID NO: 1368 - RNA, 21 nt, Artificial Sequence
  Description of Artificial Sequence: Synthetic oligonucleotide
ucagcugggaagauaucaaau

SEQ ID NO: 1369 - RNA, 23 nt, Artificial Sequence
  Description of Artificial Sequence: Synthetic oligonucleotide
auuugauaucuucccagcugaua

SEQ ID NO: 1370 - RNA, 21 nt, Artificial Sequence
  Description of Artificial Sequence: Synthetic oligonucleotide
uccaaagucuauauaugacua

SEQ ID NO: 1371 - RNA, 23 nt, Artificial Sequence
  Description of Artificial Sequence: Synthetic oligonucleotide
uagucauauauagacuuuggaag

SEQ ID NO: 1372 - RNA, 21 nt, Artificial Sequence
  Description of Artificial Sequence: Synthetic oligonucleotide
ccaaagucuauauaugacuau

SEQ ID NO: 1373 - RNA, 23 nt, Artificial Sequence
  Description of Artificial Sequence: Synthetic oligonucleotide
auagucauauauagacuuuggaa

SEQ ID NO: 1374 - RNA, 21 nt, Artificial Sequence
  Description of Artificial Sequence: Synthetic oligonucleotide
uacuuccaaagucuauauaug

SEQ ID NO: 1375 - RNA, 23 nt, Artificial Sequence
  Description of Artificial Sequence: Synthetic oligonucleotide
cauauauagacuuuggaaguacu

SEQ ID NO: 1376 - RNA, 21 nt, Artificial Sequence
  Description of Artificial Sequence: Synthetic oligonucleotide
guacuuccaaagucuauauau

SEQ ID NO: 1377 - RNA, 23 nt, Artificial Sequence
  Description of Artificial Sequence: Synthetic oligonucleotide
auauauagacuuuggaaguacug

SEQ ID NO: 1378 - RNA, 21 nt, Artificial Sequence
  Description of Artificial Sequence: Synthetic oligonucleotide
uuaugaacaacaugcuaaauc

SEQ ID NO: 1379 - RNA, 23 nt, Artificial Sequence
  Description of Artificial Sequence: Synthetic oligonucleotide
gauuuagcauguuguucauaauc

SEQ ID NO: 1380 - RNA, 21 nt, Artificial Sequence
  Description of Artificial Sequence: Synthetic oligonucleotide
uaugaacaacaugcuaaauca

SEQ ID NO: 1381 - RNA, 23 nt, Artificial Sequence
  Description of Artificial Sequence: Synthetic oligonucleotide
ugauuuagcauguuguucauaau

SEQ ID NO: 1382 - RNA, 21 nt, Artificial Sequence
  Description of Artificial Sequence: Synthetic oligonucleotide
augauuaugaacaacaugcua

SEQ ID NO: 1383 - RNA, 23 nt, Artificial Sequence
  Description of Artificial Sequence: Synthetic oligonucleotide
uagcauguuguucauaaucauug

SEQ ID NO: 1384 - RNA, 21 nt, Artificial Sequence
  Description of Artificial Sequence: Synthetic oligonucleotide
aaugauuaugaacaacaugcu

SEQ ID NO: 1385 - RNA, 23 nt, Artificial Sequence
  Description of Artificial Sequence: Synthetic oligonucleotide
agcauguuguucauaaucauuga

SEQ ID NO: 1386 - RNA, 21 nt, Artificial Sequence
  Description of Artificial Sequence: Synthetic oligonucleotide
aauuccccacuucaauacaaa

SEQ ID NO: 1387 - RNA, 23 nt, Artificial Sequence
  Description of Artificial Sequence: Synthetic oligonucleotide
uuuguauugaaguggggaauuac

SEQ ID NO: 1388 - RNA, 21 nt, Artificial Sequence
  Description of Artificial Sequence: Synthetic oligonucleotide
auuccccacuucaauacaaag

SEQ ID NO: 1389 - RNA, 23 nt, Artificial Sequence
  Description of Artificial Sequence: Synthetic oligonucleotide
cuuuguauugaaguggggaauua

SEQ ID NO: 1390 - RNA, 21 nt, Artificial Sequence
  Description of Artificial Sequence: Synthetic oligonucleotide
cuguaauuccccacuucaaua

SEQ ID NO: 1391 - RNA, 23 nt, Artificial Sequence
  Description of Artificial Sequence: Synthetic oligonucleotide
uauugaaguggggaauuacagac

SEQ ID NO: 1392 - RNA, 21 nt, Artificial Sequence
  Description of Artificial Sequence: Synthetic oligonucleotide
ucuguaauuccccacuucaau

SEQ ID NO: 1393 - RNA, 23 nt, Artificial Sequence
  Description of Artificial Sequence: Synthetic oligonucleotide
auugaaguggggaauuacagacu

SEQ ID NO: 1394 - RNA, 21 nt, Artificial Sequence
  Description of Artificial Sequence: Synthetic oligonucleotide
ugaugugcguaacagauucaa

SEQ ID NO: 1395 - RNA, 23 nt, Artificial Sequence
  Description of Artificial Sequence: Synthetic oligonucleotide
uugaaucuguuacgcacaucauc

SEQ ID NO: 1396 - RNA, 21 nt, Artificial Sequence
  Description of Artificial Sequence: Synthetic oligonucleotide
gaugugcguaacagauucaaa

SEQ ID NO: 1397 - RNA, 23 nt, Artificial Sequence
  Description of Artificial Sequence: Synthetic oligonucleotide
uuugaaucuguuacgcacaucau

SEQ ID NO: 1398 - RNA, 21 nt, Artificial Sequence
  Description of Artificial Sequence: Synthetic oligonucleotide
uggaugaugugcguaacagau

SEQ ID NO: 1399 - RNA, 23 nt, Artificial Sequence
  Description of Artificial Sequence: Synthetic oligonucleotide
aucuguuacgcacaucauccaga

SEQ ID NO: 1400 - RNA, 21 nt, Artificial Sequence
  Description of Artificial Sequence: Synthetic oligonucleotide
cuggaugaugugcguaacaga

SEQ ID NO: 1401 - RNA, 23 nt, Artificial Sequence
  Description of Artificial Sequence: Synthetic oligonucleotide
ucuguuacgcacaucauccagac

SEQ ID NO: 1402 - RNA, 21 nt, Artificial Sequence
  Description of Artificial Sequence: Synthetic oligonucleotide
gaauggguggcgguaauuggu

SEQ ID NO: 1403 - RNA, 23 nt, Artificial Sequence
  Description of Artificial Sequence: Synthetic oligonucleotide
accaauuaccgccacccauucca

SEQ ID NO: 1404 - RNA, 21 nt, Artificial Sequence
  Description of Artificial Sequence: Synthetic oligonucleotide
aauggguggcgguaauuggug

SEQ ID NO: 1405 - RNA, 23 nt, Artificial Sequence
  Description of Artificial Sequence: Synthetic oligonucleotide
caccaauuaccgccacccauucc

SEQ ID NO: 1406 - RNA, 21 nt, Artificial Sequence
  Description of Artificial Sequence: Synthetic oligonucleotide
auuggaauggguggcgguaau

SEQ ID NO: 1407 - RNA, 23 nt, Artificial Sequence
  Description of Artificial Sequence: Synthetic oligonucleotide
auuaccgccacccauuccaauuc

SEQ ID NO: 1408 - RNA, 21 nt, Artificial Sequence
  Description of Artificial Sequence: Synthetic oligonucleotide
aauuggaauggguggcgguaa

SEQ ID NO: 1409 - RNA, 23 nt, Artificial Sequence
  Description of Artificial Sequence: Synthetic oligonucleotide
uuaccgccacccauuccaauucu

SEQ ID NO: 1410 - RNA, 21 nt, Artificial Sequence
  Description of Artificial Sequence: Synthetic oligonucleotide
uccggaauguugcugaaacag

SEQ ID NO: 1411 - RNA, 23 nt, Artificial Sequence
  Description of Artificial Sequence: Synthetic oligonucleotide
cuguuucagcaacauuccggagc

SEQ ID NO: 1412 - RNA, 21 nt, Artificial Sequence
  Description of Artificial Sequence: Synthetic oligonucleotide
ccggaauguugcugaaacaga

SEQ ID NO: 1413 - RNA, 23 nt, Artificial Sequence
  Description of Artificial Sequence: Synthetic oligonucleotide
ucuguuucagcaacauuccggag

SEQ ID NO: 1414 - RNA, 21 nt, Artificial Sequence
  Description of Artificial Sequence: Synthetic oligonucleotide
augcuccggaauguugcugaa

SEQ ID NO: 1415 - RNA, 23 nt, Artificial Sequence
  Description of Artificial Sequence: Synthetic oligonucleotide
uucagcaacauuccggagcaucc

SEQ ID NO: 1416 - RNA, 21 nt, Artificial Sequence
  Description of Artificial Sequence: Synthetic oligonucleotide
gaugcuccggaauguugcuga

SEQ ID NO: 1417 - RNA, 23 nt, Artificial Sequence
  Description of Artificial Sequence: Synthetic oligonucleotide
ucagcaacauuccggagcauccu

SEQ ID NO: 1418 - RNA, 21 nt, Artificial Sequence
  Description of Artificial Sequence: Synthetic oligonucleotide
uguccucgagauacuaaagga

SEQ ID NO: 1419 - RNA, 23 nt, Artificial Sequence
  Description of Artificial Sequence: Synthetic oligonucleotide
uccuuuaguaucucgaggacauc

SEQ ID NO: 1420 - RNA, 21 nt, Artificial Sequence
  Description of Artificial Sequence: Synthetic oligonucleotide
guccucgagauacuaaaggaa

SEQ ID NO: 1421 - RNA, 23 nt, Artificial Sequence
  Description of Artificial Sequence: Synthetic oligonucleotide
uuccuuuaguaucucgaggacau

SEQ ID NO: 1422 - RNA, 21 nt, Artificial Sequence
  Description of Artificial Sequence: Synthetic oligonucleotide
aagauguccucgagauacuaa

SEQ ID NO: 1423 - RNA, 23 nt, Artificial Sequence
  Description of Artificial Sequence: Synthetic oligonucleotide
uuaguaucucgaggacaucuuga

SEQ ID NO: 1424 - RNA, 21 nt, Artificial Sequence
  Description of Artificial Sequence: Synthetic oligonucleotide
caagauguccucgagauacua

SEQ ID NO: 1425 - RNA, 23 nt, Artificial Sequence
  Description of Artificial Sequence: Synthetic oligonucleotide
uaguaucucgaggacaucuugaa

SEQ ID NO: 1426 - RNA, 21 nt, Artificial Sequence
  Description of Artificial Sequence: Synthetic oligonucleotide
acaacaugcuaaaucaguacu

SEQ ID NO: 1427 - RNA, 23 nt, Artificial Sequence
  Description of Artificial Sequence: Synthetic oligonucleotide
aguacugauuuagcauguuguuc

SEQ ID NO: 1428 - RNA, 21 nt, Artificial Sequence
  Description of Artificial Sequence: Synthetic oligonucleotide
caacaugcuaaaucaguacuu

SEQ ID NO: 1429 - RNA, 23 nt, Artificial Sequence
  Description of Artificial Sequence: Synthetic oligonucleotide
aaguacugauuuagcauguuguu

SEQ ID NO: 1430 - RNA, 21 nt, Artificial Sequence
  Description of Artificial Sequence: Synthetic oligonucleotide
augaacaacaugcuaaaucag

SEQ ID NO: 1431 - RNA, 23 nt, Artificial Sequence
  Description of Artificial Sequence: Synthetic oligonucleotide
cugauuuagcauguuguucauaa

SEQ ID NO: 1432 - RNA, 21 nt, Artificial Sequence
  Description of Artificial Sequence: Synthetic oligonucleotide
uaugaacaacaugcuaaauca

SEQ ID NO: 1433 - RNA, 23 nt, Artificial Sequence
  Description of Artificial Sequence: Synthetic oligonucleotide
ugauuuagcauguuguucauaau

SEQ ID NO: 1434 - RNA, 21 nt, Artificial Sequence
  Description of Artificial Sequence: Synthetic oligonucleotide
gccaaggcuguguuugugggg

SEQ ID NO: 1435 - RNA, 23 nt, Artificial Sequence
  Description of Artificial Sequence: Synthetic oligonucleotide
ccccacaaacacagccuuggcgc

SEQ ID NO: 1436 - RNA, 21 nt, Artificial Sequence
  Description of Artificial Sequence: Synthetic oligonucleotide
ccaaggcuguguuugugggga

SEQ ID NO: 1437 - RNA, 23 nt, Artificial Sequence
  Description of Artificial Sequence: Synthetic oligonucleotide
uccccacaaacacagccuuggcg

SEQ ID NO: 1438 - RNA, 21 nt, Artificial Sequence
  Description of Artificial Sequence: Synthetic oligonucleotide
uggcgccaaggcuguguuugu

SEQ ID NO: 1439 - RNA, 23 nt, Artificial Sequence
  Description of Artificial Sequence: Synthetic oligonucleotide
acaaacacagccuuggcgccaag

SEQ ID NO: 1440 - RNA, 21 nt, Artificial Sequence
  Description of Artificial Sequence: Synthetic oligonucleotide
uuggcgccaaggcuguguuug

SEQ ID NO: 1441 - RNA, 23 nt, Artificial Sequence
  Description of Artificial Sequence: Synthetic oligonucleotide
caaacacagccuuggcgccaaga

SEQ ID NO: 1442 - RNA, 21 nt, Artificial Sequence
  Description of Artificial Sequence: Synthetic oligonucleotide
ugaaagcucuggcucuuggcg

SEQ ID NO: 1443 - RNA, 23 nt, Artificial Sequence
  Description of Artificial Sequence: Synthetic oligonucleotide
cgccaagagccagagcuuucaga

SEQ ID NO: 1444 - RNA, 21 nt, Artificial Sequence
  Description of Artificial Sequence: Synthetic oligonucleotide
gaaagcucuggcucuuggcgc

SEQ ID NO: 1445 - RNA, 23 nt, Artificial Sequence
  Description of Artificial Sequence: Synthetic oligonucleotide
gcgccaagagccagagcuuucag

SEQ ID NO: 1446 - RNA, 21 nt, Artificial Sequence
  Description of Artificial Sequence: Synthetic oligonucleotide
guucugaaagcucuggcucuu

SEQ ID NO: 1447 - RNA, 23 nt, Artificial Sequence
  Description of Artificial Sequence: Synthetic oligonucleotide
aagagccagagcuuucagaacau

SEQ ID NO: 1448 - RNA, 21 nt, Artificial Sequence
  Description of Artificial Sequence: Synthetic oligonucleotide
uguucugaaagcucuggcucu

SEQ ID NO: 1449 - RNA, 23 nt, Artificial Sequence
  Description of Artificial Sequence: Synthetic oligonucleotide
agagccagagcuuucagaacauc

SEQ ID NO: 1450 - RNA, 21 nt, Artificial Sequence
  Description of Artificial Sequence: Synthetic oligonucleotide
cagccacuauugauguucugc

SEQ ID NO: 1451 - RNA, 23 nt, Artificial Sequence
  Description of Artificial Sequence: Synthetic oligonucleotide
gcagaacaucaauaguggcuggc

SEQ ID NO: 1452 - RNA, 21 nt, Artificial Sequence
  Description of Artificial Sequence: Synthetic oligonucleotide
agccacuauugauguucugcc

SEQ ID NO: 1453 - RNA, 23 nt, Artificial Sequence
  Description of Artificial Sequence: Synthetic oligonucleotide
ggcagaacaucaauaguggcugg

SEQ ID NO: 1454 - RNA, 21 nt, Artificial Sequence
  Description of Artificial Sequence: Synthetic oligonucleotide
gugccagccacuauugauguu

SEQ ID NO: 1455 - RNA, 23 nt, Artificial Sequence
  Description of Artificial Sequence: Synthetic oligonucleotide
aacaucaauaguggcuggcaccc

SEQ ID NO: 1456 - RNA, 21 nt, Artificial Sequence
  Description of Artificial Sequence: Synthetic oligonucleotide
ggugccagccacuauugaugu

SEQ ID NO: 1457 - RNA, 23 nt, Artificial Sequence
  Description of Artificial Sequence: Synthetic oligonucleotide
acaucaauaguggcuggcacccc

SEQ ID NO: 1458 - RNA, 21 nt, Artificial Sequence
  Description of Artificial Sequence: Synthetic oligonucleotide
acaaggaccgagaagucacca

SEQ ID NO: 1459 - RNA, 23 nt, Artificial Sequence
  Description of Artificial Sequence: Synthetic oligonucleotide
uggugacuucucgguccuuguag

SEQ ID NO: 1460 - RNA, 21 nt, Artificial Sequence
  Description of Artificial Sequence: Synthetic oligonucleotide
caaggaccgagaagucaccaa

SEQ ID NO: 1461 - RNA, 23 nt, Artificial Sequence
  Description of Artificial Sequence: Synthetic oligonucleotide
uuggugacuucucgguccuugua

SEQ ID NO: 1462 - RNA, 21 nt, Artificial Sequence
  Description of Artificial Sequence: Synthetic oligonucleotide
aucuacaaggaccgagaaguc

SEQ ID NO: 1463 - RNA, 23 nt, Artificial Sequence
  Description of Artificial Sequence: Synthetic oligonucleotide
gacuucucgguccuuguagauau

SEQ ID NO: 1464 - RNA, 21 nt, Artificial Sequence
  Description of Artificial Sequence: Synthetic oligonucleotide
uaucuacaaggaccgagaagu

SEQ ID NO: 1465 - RNA, 23 nt, Artificial Sequence
  Description of Artificial Sequence: Synthetic oligonucleotide
acuucucgguccuuguagauaua

SEQ ID NO: 1466 - RNA, 21 nt, Artificial Sequence
  Description of Artificial Sequence: Synthetic oligonucleotide
cagaaugugaaagucaucgac

SEQ ID NO: 1467 - RNA, 23 nt, Artificial Sequence
  Description of Artificial Sequence: Synthetic oligonucleotide
gucgaugacuuucacauucuggc

SEQ ID NO: 1468 - RNA, 21 nt, Artificial Sequence
  Description of Artificial Sequence: Synthetic oligonucleotide
agaaugugaaagucaucgaca

SEQ ID NO: 1469 - RNA, 23 nt, Artificial Sequence
  Description of Artificial Sequence: Synthetic oligonucleotide
ugucgaugacuuucacauucugg

SEQ ID NO: 1470 - RNA, 21 nt, Artificial Sequence
  Description of Artificial Sequence: Synthetic oligonucleotide
gugccagaaugugaaagucau

SEQ ID NO: 1471 - RNA, 23 nt, Artificial Sequence
  Description of Artificial Sequence: Synthetic oligonucleotide
augacuuucacauucuggcaccc

SEQ ID NO: 1472 - RNA, 21 nt, Artificial Sequence
  Description of Artificial Sequence: Synthetic oligonucleotide
ggugccagaaugugaaaguca

SEQ ID NO: 1473 - RNA, 23 nt, Artificial Sequence
  Description of Artificial Sequence: Synthetic oligonucleotide
ugacuuucacauucuggcaccca

SEQ ID NO: 1474 - RNA, 21 nt, Artificial Sequence
  Description of Artificial Sequence: Synthetic oligonucleotide
agauguccucgagauacuaaa

SEQ ID NO: 1475 - RNA, 23 nt, Artificial Sequence
  Description of Artificial Sequence: Synthetic oligonucleotide
uuuaguaucucgaggacaucuug

SEQ ID NO: 1476 - RNA, 21 nt, Artificial Sequence
  Description of Artificial Sequence: Synthetic oligonucleotide
gauguccucgagauacuaaag

SEQ ID NO: 1477 - RNA, 23 nt, Artificial Sequence
  Description of Artificial Sequence: Synthetic oligonucleotide
cuuuaguaucucgaggacaucuu

SEQ ID NO: 1478 - RNA, 21 nt, Artificial Sequence
  Description of Artificial Sequence: Synthetic oligonucleotide
uucaagauguccucgagauac

SEQ ID NO: 1479 - RNA, 23 nt, Artificial Sequence
  Description of Artificial Sequence: Synthetic oligonucleotide
guaucucgaggacaucuugaaca

SEQ ID NO: 1480 - RNA, 21 nt, Artificial Sequence
  Description of Artificial Sequence: Synthetic oligonucleotide
guucaagauguccucgagaua

SEQ ID NO: 1481 - RNA, 23 nt, Artificial Sequence
  Description of Artificial Sequence: Synthetic oligonucleotide
uaucucgaggacaucuugaacac

SEQ ID NO: 1482 - RNA, 21 nt, Artificial Sequence
  Description of Artificial Sequence: Synthetic oligonucleotide
guggacuugcugcauaugugg

SEQ ID NO: 1483 - RNA, 23 nt, Artificial Sequence
  Description of Artificial Sequence: Synthetic oligonucleotide
ccacauaugcagcaaguccacug

SEQ ID NO: 1484 - RNA, 21 nt, Artificial Sequence
  Description of Artificial Sequence: Synthetic oligonucleotide
uggacuugcugcauauguggc

SEQ ID NO: 1485 - RNA, 23 nt, Artificial Sequence
  Description of Artificial Sequence: Synthetic oligonucleotide
gccacauaugcagcaaguccacu

SEQ ID NO: 1486 - RNA, 21 nt, Artificial Sequence
  Description of Artificial Sequence: Synthetic oligonucleotide
gacaguggacuugcugcauau

SEQ ID NO: 1487 - RNA, 23 nt, Artificial Sequence
  Description of Artificial Sequence: Synthetic oligonucleotide
auaugcagcaaguccacugucgu

SEQ ID NO: 1488 - RNA, 21 nt, Artificial Sequence
  Description of Artificial Sequence: Synthetic oligonucleotide
cgacaguggacuugcugcaua

SEQ ID NO: 1489 - RNA, 23 nt, Artificial Sequence
  Description of Artificial Sequence: Synthetic oligonucleotide
uaugcagcaaguccacugucguc

SEQ ID NO: 1490 - RNA, 21 nt, Artificial Sequence
  Description of Artificial Sequence: Synthetic oligonucleotide
aaccaguacuuuaucauuuuc

SEQ ID NO: 1491 - RNA, 23 nt, Artificial Sequence
  Description of Artificial Sequence: Synthetic oligonucleotide
gaaaaugauaaaguacugguuuc

SEQ ID NO: 1492 - RNA, 21 nt, Artificial Sequence
  Description of Artificial Sequence: Synthetic oligonucleotide
accaguacuuuaucauuuucu

SEQ ID NO: 1493 - RNA, 23 nt, Artificial Sequence
  Description of Artificial Sequence: Synthetic oligonucleotide
agaaaaugauaaaguacugguuu

SEQ ID NO: 1494 - RNA, 21 nt, Artificial Sequence
  Description of Artificial Sequence: Synthetic oligonucleotide
uugaaaccaguacuuuaucau

SEQ ID NO: 1495 - RNA, 23 nt, Artificial Sequence
  Description of Artificial Sequence: Synthetic oligonucleotide
augauaaaguacugguuucaaaa

SEQ ID NO: 1496 - RNA, 21 nt, Artificial Sequence
  Description of Artificial Sequence: Synthetic oligonucleotide
uuugaaaccaguacuuuauca

SEQ ID NO: 1497 - RNA, 23 nt, Artificial Sequence
  Description of Artificial Sequence: Synthetic oligonucleotide
ugauaaaguacugguuucaaaau

SEQ ID NO: 1498 - RNA, 21 nt, Artificial Sequence
  Description of Artificial Sequence: Synthetic oligonucleotide
cgagaagucaccaagaagcua

SEQ ID NO: 1499 - RNA, 23 nt, Artificial Sequence
  Description of Artificial Sequence: Synthetic oligonucleotide
uagcuucuuggugacuucucggu

SEQ ID NO: 1500 - RNA, 21 nt, Artificial Sequence
  Description of Artificial Sequence: Synthetic oligonucleotide
gagaagucaccaagaagcuag

SEQ ID NO: 1501 - RNA, 23 nt, Artificial Sequence
  Description of Artificial Sequence: Synthetic oligonucleotide
cuagcuucuuggugacuucucgg

SEQ ID NO: 1502 - RNA, 21 nt, Artificial Sequence
  Description of Artificial Sequence: Synthetic oligonucleotide
ggaccgagaagucaccaagaa

SEQ ID NO: 1503 - RNA, 23 nt, Artificial Sequence
  Description of Artificial Sequence: Synthetic oligonucleotide
uucuuggugacuucucgguccuu

SEQ ID NO: 1504 - RNA, 21 nt, Artificial Sequence
  Description of Artificial Sequence: Synthetic oligonucleotide
aggaccgagaagucaccaaga

SEQ ID NO: 1505 - RNA, 23 nt, Artificial Sequence
  Description of Artificial Sequence: Synthetic oligonucleotide
ucuuggugacuucucgguccuug

SEQ ID NO: 1506 - RNA, 21 nt, Artificial Sequence
  Description of Artificial Sequence: Synthetic oligonucleotide
ucaaaguguugguaaugccug

SEQ ID NO: 1507 - RNA, 23 nt, Artificial Sequence
  Description of Artificial Sequence: Synthetic oligonucleotide
caggcauuaccaacacuuugaac

SEQ ID NO: 1508 - RNA, 21 nt, Artificial Sequence
  Description of Artificial Sequence: Synthetic oligonucleotide
caaaguguugguaaugccuga

SEQ ID NO: 1509 - RNA, 23 nt, Artificial Sequence
  Description of Artificial Sequence: Synthetic oligonucleotide
ucaggcauuaccaacacuuugaa

SEQ ID NO: 1510 - RNA, 21 nt, Artificial Sequence
  Description of Artificial Sequence: Synthetic oligonucleotide
agguucaaaguguugguaaug

SEQ ID NO: 1511 - RNA, 23 nt, Artificial Sequence
  Description of Artificial Sequence: Synthetic oligonucleotide
cauuaccaacacuuugaaccuga

SEQ ID NO: 1512 - RNA, 21 nt, Artificial Sequence
  Description of Artificial Sequence: Synthetic oligonucleotide
cagguucaaaguguugguaau

SEQ ID NO: 1513 - RNA, 23 nt, Artificial Sequence
  Description of Artificial Sequence: Synthetic oligonucleotide
auuaccaacacuuugaaccugag

SEQ ID NO: 1514 - RNA, 21 nt, Artificial Sequence
  Description of Artificial Sequence: Synthetic oligonucleotide
uauuacuugacaaagagacac

SEQ ID NO: 1515 - RNA, 23 nt, Artificial Sequence
  Description of Artificial Sequence: Synthetic oligonucleotide
gugucucuuugucaaguaauaca

SEQ ID NO: 1516 - RNA, 21 nt, Artificial Sequence
  Description of Artificial Sequence: Synthetic oligonucleotide
auuacuugacaaagagacacu

SEQ ID NO: 1517 - RNA, 23 nt, Artificial Sequence
  Description of Artificial Sequence: Synthetic oligonucleotide
agugucucuuugucaaguaauac

SEQ ID NO: 1518 - RNA, 21 nt, Artificial Sequence
  Description of Artificial Sequence: Synthetic oligonucleotide
cauguauuacuugacaaagag

SEQ ID NO: 1519 - RNA, 23 nt, Artificial Sequence
  Description of Artificial Sequence: Synthetic oligonucleotide
cucuuugucaaguaauacaugcu

SEQ ID NO: 1520 - RNA, 21 nt, Artificial Sequence
  Description of Artificial Sequence: Synthetic oligonucleotide
gcauguauuacuugacaaaga

SEQ ID NO: 1521 - RNA, 23 nt, Artificial Sequence
  Description of Artificial Sequence: Synthetic oligonucleotide
ucuuugucaaguaauacaugcug

SEQ ID NO: 1522 - RNA, 21 nt, Artificial Sequence
  Description of Artificial Sequence: Synthetic oligonucleotide
aaagucaucgacaagacauug

SEQ ID NO: 1523 - RNA, 23 nt, Artificial Sequence
  Description of Artificial Sequence: Synthetic oligonucleotide
caaugucuugucgaugacuuuca

SEQ ID NO: 1524 - RNA, 21 nt, Artificial Sequence
  Description of Artificial Sequence: Synthetic oligonucleotide
aagucaucgacaagacauugg

SEQ ID NO: 1525 - RNA, 23 nt, Artificial Sequence
  Description of Artificial Sequence: Synthetic oligonucleotide
ccaaugucuugucgaugacuuuc

SEQ ID NO: 1526 - RNA, 21 nt, Artificial Sequence
  Description of Artificial Sequence: Synthetic oligonucleotide
ugugaaagucaucgacaagac

SEQ ID NO: 1527 - RNA, 23 nt, Artificial Sequence
  Description of Artificial Sequence: Synthetic oligonucleotide
gucuugucgaugacuuucacauu

SEQ ID NO: 1528 - RNA, 21 nt, Artificial Sequence
  Description of Artificial Sequence: Synthetic oligonucleotide
augugaaagucaucgacaaga

SEQ ID NO: 1529 - RNA, 23 nt, Artificial Sequence
  Description of Artificial Sequence: Synthetic oligonucleotide
ucuugucgaugacuuucacauuc

SEQ ID NO: 1530 - RNA, 21 nt, Artificial Sequence
  Description of Artificial Sequence: Synthetic oligonucleotide
auauguggcuaaagcaauaga

SEQ ID NO: 1531 - RNA, 23 nt, Artificial Sequence
  Description of Artificial Sequence: Synthetic oligonucleotide
ucuauugcuuuagccacauaugc

SEQ ID NO: 1532 - RNA, 21 nt, Artificial Sequence
  Description of Artificial Sequence: Synthetic oligonucleotide
uauguggcuaaagcaauagac

SEQ ID NO: 1533 - RNA, 23 nt, Artificial Sequence
  Description of Artificial Sequence: Synthetic oligonucleotide
gucuauugcuuuagccacauaug

SEQ ID NO: 1534 - RNA, 21 nt, Artificial Sequence
  Description of Artificial Sequence: Synthetic oligonucleotide
cugcauauguggcuaaagcaa

SEQ ID NO: 1535 - RNA, 23 nt, Artificial Sequence
  Description of Artificial Sequence: Synthetic oligonucleotide
uugcuuuagccacauaugcagca

SEQ ID NO: 1536 - RNA, 21 nt, Artificial Sequence
  Description of Artificial Sequence: Synthetic oligonucleotide
gcugcauauguggcuaaagca

SEQ ID NO: 1537 - RNA, 23 nt, Artificial Sequence
  Description of Artificial Sequence: Synthetic oligonucleotide
ugcuuuagccacauaugcagcaa

SEQ ID NO: 1538 - RNA, 21 nt, Artificial Sequence
  Description of Artificial Sequence: Synthetic oligonucleotide
agacgacaguggacuugcugc

SEQ ID NO: 1539 - RNA, 23 nt, Artificial Sequence
  Description of Artificial Sequence: Synthetic oligonucleotide
gcagcaaguccacugucgucucc

SEQ ID NO: 1540 - RNA, 21 nt, Artificial Sequence
  Description of Artificial Sequence: Synthetic oligonucleotide
gacgacaguggacuugcugca

SEQ ID NO: 1541 - RNA, 23 nt, Artificial Sequence
  Description of Artificial Sequence: Synthetic oligonucleotide
ugcagcaaguccacugucgucuc

SEQ ID NO: 1542 - RNA, 21 nt, Artificial Sequence
  Description of Artificial Sequence: Synthetic oligonucleotide
uuggagacgacaguggacuug

SEQ ID NO: 1543 - RNA, 23 nt, Artificial Sequence
  Description of Artificial Sequence: Synthetic oligonucleotide
caaguccacugucgucuccaaaa

SEQ ID NO: 1544 - RNA, 21 nt, Artificial Sequence
  Description of Artificial Sequence: Synthetic oligonucleotide
uuuggagacgacaguggacuu

SEQ ID NO: 1545 - RNA, 23 nt, Artificial Sequence
  Description of Artificial Sequence: Synthetic oligonucleotide
aaguccacugucgucuccaaaau

SEQ ID NO: 1546 - RNA, 21 nt, Artificial Sequence
  Description of Artificial Sequence: Synthetic oligonucleotide
ggccaccuccucaauugaaga

SEQ ID NO: 1547 - RNA, 23 nt, Artificial Sequence
  Description of Artificial Sequence: Synthetic oligonucleotide
ucuucaauugaggagguggccca

SEQ ID NO: 1548 - RNA, 21 nt, Artificial Sequence
  Description of Artificial Sequence: Synthetic oligonucleotide
gccaccuccucaauugaagaa

SEQ ID NO: 1549 - RNA, 23 nt, Artificial Sequence
  Description of Artificial Sequence: Synthetic oligonucleotide
uucuucaauugaggagguggccc

SEQ ID NO: 1550 - RNA, 21 nt, Artificial Sequence
  Description of Artificial Sequence: Synthetic oligonucleotide
ccugggccaccuccucaauug

SEQ ID NO: 1551 - RNA, 23 nt, Artificial Sequence
  Description of Artificial Sequence: Synthetic oligonucleotide
caauugaggagguggcccaggaa

SEQ ID NO: 1552 - RNA, 21 nt, Artificial Sequence
  Description of Artificial Sequence: Synthetic oligonucleotide
uccugggccaccuccucaauu

SEQ ID NO: 1553 - RNA, 23 nt, Artificial Sequence
  Description of Artificial Sequence: Synthetic oligonucleotide
aauugaggagguggcccaggaac

SEQ ID NO: 1554 - RNA, 21 nt, Artificial Sequence
  Description of Artificial Sequence: Synthetic oligonucleotide
uguauguuacuucuuagagag

SEQ ID NO: 1555 - RNA, 23 nt, Artificial Sequence
  Description of Artificial Sequence: Synthetic oligonucleotide
cucucuaagaaguaacauacauc

SEQ ID NO: 1556 - RNA, 21 nt, Artificial Sequence
  Description of Artificial Sequence: Synthetic oligonucleotide
guauguuacuucuuagagaga

SEQ ID NO: 1557 - RNA, 23 nt, Artificial Sequence
  Description of Artificial Sequence: Synthetic oligonucleotide
ucucucuaagaaguaacauacau

SEQ ID NO: 1558 - RNA, 21 nt, Artificial Sequence
  Description of Artificial Sequence: Synthetic oligonucleotide
aggauguauguuacuucuuag

SEQ ID NO: 1559 - RNA, 23 nt, Artificial Sequence
  Description of Artificial Sequence: Synthetic oligonucleotide
cuaagaaguaacauacauccuaa

SEQ ID NO: 1560 - RNA, 21 nt, Artificial Sequence
  Description of Artificial Sequence: Synthetic oligonucleotide
uaggauguauguuacuucuua

SEQ ID NO: 1561 - RNA, 23 nt, Artificial Sequence
  Description of Artificial Sequence: Synthetic oligonucleotide
uaagaaguaacauacauccuaaa

SEQ ID NO: 1562 - RNA, 21 nt, Artificial Sequence
  Description of Artificial Sequence: Synthetic oligonucleotide
aaauguuuuaggauguauguu

SEQ ID NO: 1563 - RNA, 23 nt, Artificial Sequence
  Description of Artificial Sequence: Synthetic oligonucleotide
aacauacauccuaaaacauuugg

SEQ ID NO: 1564 - RNA, 21 nt, Artificial Sequence
  Description of Artificial Sequence: Synthetic oligonucleotide
aauguuuuaggauguauguua

SEQ ID NO: 1565 - RNA, 23 nt, Artificial Sequence
  Description of Artificial Sequence: Synthetic oligonucleotide
uaacauacauccuaaaacauuug

SEQ ID NO: 1566 - RNA, 21 nt, Artificial Sequence
  Description of Artificial Sequence: Synthetic oligonucleotide
auccaaauguuuuaggaugua

SEQ ID NO: 1567 - RNA, 23 nt, Artificial Sequence
  Description of Artificial Sequence: Synthetic oligonucleotide
uacauccuaaaacauuuggauau

SEQ ID NO: 1568 - RNA, 21 nt, Artificial Sequence
  Description of Artificial Sequence: Synthetic oligonucleotide
uauccaaauguuuuaggaugu

SEQ ID NO: 1569 - RNA, 23 nt, Artificial Sequence
  Description of Artificial Sequence: Synthetic oligonucleotide
acauccuaaaacauuuggauaua

SEQ ID NO: 1570 - RNA, 21 nt, Artificial Sequence
  Description of Artificial Sequence: Synthetic oligonucleotide
auggguggcgguaauugguga

SEQ ID NO: 1571 - RNA, 23 nt, Artificial Sequence
  Description of Artificial Sequence: Synthetic oligonucleotide
ucaccaauuaccgccacccauuc

SEQ ID NO: 1572 - RNA, 21 nt, Artificial Sequence
  Description of Artificial Sequence: Synthetic oligonucleotide
uggguggcgguaauuggugau

SEQ ID NO: 1573 - RNA, 23 nt, Artificial Sequence
  Description of Artificial Sequence: Synthetic oligonucleotide
aucaccaauuaccgccacccauu

SEQ ID NO: 1574 - RNA, 21 nt, Artificial Sequence
  Description of Artificial Sequence: Synthetic oligonucleotide
uggaauggguggcgguaauug

SEQ ID NO: 1575 - RNA, 23 nt, Artificial Sequence
  Description of Artificial Sequence: Synthetic oligonucleotide
caauuaccgccacccauuccaau

SEQ ID NO: 1576 - RNA, 21 nt, Artificial Sequence
  Description of Artificial Sequence: Synthetic oligonucleotide
uuggaauggguggcgguaauu

SEQ ID NO: 1577 - RNA, 23 nt, Artificial Sequence
  Description of Artificial Sequence: Synthetic oligonucleotide
aauuaccgccacccauuccaauu

SEQ ID NO: 1578 - RNA, 21 nt, Artificial Sequence
  Description of Artificial Sequence: Synthetic oligonucleotide
uucaaaguguugguaaugccu

SEQ ID NO: 1579 - RNA, 23 nt, Artificial Sequence
  Description of Artificial Sequence: Synthetic oligonucleotide
aggcauuaccaacacuuugaacc

SEQ ID NO: 1580 - RNA, 21 nt, Artificial Sequence
  Description of Artificial Sequence: Synthetic oligonucleotide
ucaaaguguugguaaugccug

SEQ ID NO: 1581 - RNA, 23 nt, Artificial Sequence
  Description of Artificial Sequence: Synthetic oligonucleotide
caggcauuaccaacacuuugaac

SEQ ID NO: 1582 - RNA, 21 nt, Artificial Sequence
  Description of Artificial Sequence: Synthetic oligonucleotide
cagguucaaaguguugguaau

SEQ ID NO: 1583 - RNA, 23 nt, Artificial Sequence
  Description of Artificial Sequence: Synthetic oligonucleotide
auuaccaacacuuugaaccugag

SEQ ID NO: 1584 - RNA, 21 nt, Artificial Sequence
  Description of Artificial Sequence: Synthetic oligonucleotide
ucagguucaaaguguugguaa

SEQ ID NO: 1585 - RNA, 23 nt, Artificial Sequence
  Description of Artificial Sequence: Synthetic oligonucleotide
uuaccaacacuuugaaccugagc

SEQ ID NO: 1586 - RNA, 21 nt, Artificial Sequence
  Description of Artificial Sequence: Synthetic oligonucleotide
ccaccuccucaauugaagaag

SEQ ID NO: 1587 - RNA, 23 nt, Artificial Sequence
  Description of Artificial Sequence: Synthetic oligonucleotide
cuucuucaauugaggagguggcc

SEQ ID NO: 1588 - RNA, 21 nt, Artificial Sequence
  Description of Artificial Sequence: Synthetic oligonucleotide
caccuccucaauugaagaagu

SEQ ID NO: 1589 - RNA, 23 nt, Artificial Sequence
  Description of Artificial Sequence: Synthetic oligonucleotide
acuucuucaauugaggagguggc

SEQ ID NO: 1590 - RNA, 21 nt, Artificial Sequence
  Description of Artificial Sequence: Synthetic oligonucleotide
ugggccaccuccucaauugaa

SEQ ID NO: 1591 - RNA, 23 nt, Artificial Sequence
  Description of Artificial Sequence: Synthetic oligonucleotide
uucaauugaggagguggcccagg

SEQ ID NO: 1592 - RNA, 21 nt, Artificial Sequence
  Description of Artificial Sequence: Synthetic oligonucleotide
cugggccaccuccucaauuga

SEQ ID NO: 1593 - RNA, 23 nt, Artificial Sequence
  Description of Artificial Sequence: Synthetic oligonucleotide
ucaauugaggagguggcccagga

SEQ ID NO: 1594 - RNA, 21 nt, Artificial Sequence
  Description of Artificial Sequence: Synthetic oligonucleotide
gagugggugccagaaugugaa

SEQ ID NO: 1595 - RNA, 23 nt, Artificial Sequence
  Description of Artificial Sequence: Synthetic oligonucleotide
uucacauucuggcacccacucag

SEQ ID NO: 1596 - RNA, 21 nt, Artificial Sequence
  Description of Artificial Sequence: Synthetic oligonucleotide
agugggugccagaaugugaaa

SEQ ID NO: 1597 - RNA, 23 nt, Artificial Sequence
  Description of Artificial Sequence: Synthetic oligonucleotide
uuucacauucuggcacccacuca

SEQ ID NO: 1598 - RNA, 21 nt, Artificial Sequence
  Description of Artificial Sequence: Synthetic oligonucleotide
cucugagugggugccagaaug

SEQ ID NO: 1599 - RNA, 23 nt, Artificial Sequence
  Description of Artificial Sequence: Synthetic oligonucleotide
cauucuggcacccacucagagcc

SEQ ID NO: 1600 - RNA, 21 nt, Artificial Sequence
  Description of Artificial Sequence: Synthetic oligonucleotide
gcucugagugggugccagaau

SEQ ID NO: 1601 - RNA, 23 nt, Artificial Sequence
  Description of Artificial Sequence: Synthetic oligonucleotide
auucuggcacccacucagagcca

SEQ ID NO: 1602 - RNA, 21 nt, Artificial Sequence
  Description of Artificial Sequence: Synthetic oligonucleotide
gcacugauguucugaaagcuc

SEQ ID NO: 1603 - RNA, 23 nt, Artificial Sequence
  Description of Artificial Sequence: Synthetic oligonucleotide
gagcuuucagaacaucagugccu

SEQ ID NO: 1604 - RNA, 21 nt, Artificial Sequence
  Description of Artificial Sequence: Synthetic oligonucleotide
cacugauguucugaaagcucu

SEQ ID NO: 1605 - RNA, 23 nt, Artificial Sequence
  Description of Artificial Sequence: Synthetic oligonucleotide
agagcuuucagaacaucagugcc

SEQ ID NO: 1606 - RNA, 21 nt, Artificial Sequence
  Description of Artificial Sequence: Synthetic oligonucleotide
aaaggcacugauguucugaaa

SEQ ID NO: 1607 - RNA, 23 nt, Artificial Sequence
  Description of Artificial Sequence: Synthetic oligonucleotide
uuucagaacaucagugccuuucc

SEQ ID NO: 1608 - RNA, 21 nt, Artificial Sequence
  Description of Artificial Sequence: Synthetic oligonucleotide
gaaaggcacugauguucugaa

SEQ ID NO: 1609 - RNA, 23 nt, Artificial Sequence
  Description of Artificial Sequence: Synthetic oligonucleotide
uucagaacaucagugccuuuccg

SEQ ID NO: 1610 - RNA, 21 nt, Artificial Sequence
  Description of Artificial Sequence: Synthetic oligonucleotide
gggaagguggaagucuuccug

SEQ ID NO: 1611 - RNA, 23 nt, Artificial Sequence
  Description of Artificial Sequence: Synthetic oligonucleotide
caggaagacuuccaccuucccuu

SEQ ID NO: 1612 - RNA, 21 nt, Artificial Sequence
  Description of Artificial Sequence: Synthetic oligonucleotide
ggaagguggaagucuuccugg

SEQ ID NO: 1613 - RNA, 23 nt, Artificial Sequence
  Description of Artificial Sequence: Synthetic oligonucleotide
ccaggaagacuuccaccuucccu

SEQ ID NO: 1614 - RNA, 21 nt, Artificial Sequence
  Description of Artificial Sequence: Synthetic oligonucleotide
ggaagggaagguggaagucuu

SEQ ID NO: 1615 - RNA, 23 nt, Artificial Sequence
  Description of Artificial Sequence: Synthetic oligonucleotide
aagacuuccaccuucccuuccac

SEQ ID NO: 1616 - RNA, 21 nt, Artificial Sequence
  Description of Artificial Sequence: Synthetic oligonucleotide
uggaagggaagguggaagucu

SEQ ID NO: 1617 - RNA, 23 nt, Artificial Sequence
  Description of Artificial Sequence: Synthetic oligonucleotide
agacuuccaccuucccuuccaca

SEQ ID NO: 1618 - RNA, 21 nt, Artificial Sequence
  Description of Artificial Sequence: Synthetic oligonucleotide
ugcuaaaucaguacuuccaaa

SEQ ID NO: 1619 - RNA, 23 nt, Artificial Sequence
  Description of Artificial Sequence: Synthetic oligonucleotide
uuuggaaguacugauuuagcaug

SEQ ID NO: 1620 - RNA, 21 nt, Artificial Sequence
  Description of Artificial Sequence: Synthetic oligonucleotide
gcuaaaucaguacuuccaaag

SEQ ID NO: 1621 - RNA, 23 nt, Artificial Sequence
  Description of Artificial Sequence: Synthetic oligonucleotide
cuuuggaaguacugauuuagcau

SEQ ID NO: 1622 - RNA, 21 nt, Artificial Sequence
  Description of Artificial Sequence: Synthetic oligonucleotide
aacaugcuaaaucaguacuuc

SEQ ID NO: 1623 - RNA, 23 nt, Artificial Sequence
  Description of Artificial Sequence: Synthetic oligonucleotide
gaaguacugauuuagcauguugu

SEQ ID NO: 1624 - RNA, 21 nt, Artificial Sequence
  Description of Artificial Sequence: Synthetic oligonucleotide
caacaugcuaaaucaguacuu

SEQ ID NO: 1625 - RNA, 23 nt, Artificial Sequence
  Description of Artificial Sequence: Synthetic oligonucleotide
aaguacugauuuagcauguuguu

SEQ ID NO: 1626 - RNA, 21 nt, Artificial Sequence
  Description of Artificial Sequence: Synthetic oligonucleotide
ccacaacucaggaugaaaaau

SEQ ID NO: 1627 - RNA, 23 nt, Artificial Sequence
  Description of Artificial Sequence: Synthetic oligonucleotide
auuuuucauccugaguuguggcg

SEQ ID NO: 1628 - RNA, 21 nt, Artificial Sequence
  Description of Artificial Sequence: Synthetic oligonucleotide
cacaacucaggaugaaaaauu

SEQ ID NO: 1629 - RNA, 23 nt, Artificial Sequence
  Description of Artificial Sequence: Synthetic oligonucleotide
aauuuuucauccugaguuguggc

SEQ ID NO: 1630 - RNA, 21 nt, Artificial Sequence
  Description of Artificial Sequence: Synthetic oligonucleotide
gccgccacaacucaggaugaa

SEQ ID NO: 1631 - RNA, 23 nt, Artificial Sequence
  Description of Artificial Sequence: Synthetic oligonucleotide
uucauccugaguuguggcggcag

SEQ ID NO: 1632 - RNA, 21 nt, Artificial Sequence
  Description of Artificial Sequence: Synthetic oligonucleotide
ugccgccacaacucaggauga

SEQ ID NO: 1633 - RNA, 23 nt, Artificial Sequence
  Description of Artificial Sequence: Synthetic oligonucleotide
ucauccugaguuguggcggcagu

SEQ ID NO: 1634 - RNA, 21 nt, Artificial Sequence
  Description of Artificial Sequence: Synthetic oligonucleotide
gcaaccgucuggaugaugugc

SEQ ID NO: 1635 - RNA, 23 nt, Artificial Sequence
  Description of Artificial Sequence: Synthetic oligonucleotide
gcacaucauccagacgguugccc

SEQ ID NO: 1636 - RNA, 21 nt, Artificial Sequence
  Description of Artificial Sequence: Synthetic oligonucleotide
caaccgucuggaugaugugcg

SEQ ID NO: 1637 - RNA, 23 nt, Artificial Sequence
  Description of Artificial Sequence: Synthetic oligonucleotide
cgcacaucauccagacgguugcc

SEQ ID NO: 1638 - RNA, 21 nt, Artificial Sequence
  Description of Artificial Sequence: Synthetic oligonucleotide
cugggcaaccgucuggaugau

SEQ ID NO: 1639 - RNA, 23 nt, Artificial Sequence
  Description of Artificial Sequence: Synthetic oligonucleotide
aucauccagacgguugcccaggu

SEQ ID NO: 1640 - RNA, 21 nt, Artificial Sequence
  Description of Artificial Sequence: Synthetic oligonucleotide
ccugggcaaccgucuggauga

SEQ ID NO: 1641 - RNA, 23 nt, Artificial Sequence
  Description of Artificial Sequence: Synthetic oligonucleotide
ucauccagacgguugcccaggua

SEQ ID NO: 1642 - RNA, 21 nt, Artificial Sequence
  Description of Artificial Sequence: Synthetic oligonucleotide
gcaaaugaugaagaaacuuug

SEQ ID NO: 1643 - RNA, 23 nt, Artificial Sequence
  Description of Artificial Sequence: Synthetic oligonucleotide
caaaguuucuucaucauuugccc

SEQ ID NO: 1644 - RNA, 21 nt, Artificial Sequence
  Description of Artificial Sequence: Synthetic oligonucleotide
caaaugaugaagaaacuuugg

SEQ ID NO: 1645 - RNA, 23 nt, Artificial Sequence
  Description of Artificial Sequence: Synthetic oligonucleotide
ccaaaguuucuucaucauuugcc

SEQ ID NO: 1646 - RNA, 21 nt, Artificial Sequence
  Description of Artificial Sequence: Synthetic oligonucleotide
uggggcaaaugaugaagaaac

SEQ ID NO: 1647 - RNA, 23 nt, Artificial Sequence
  Description of Artificial Sequence: Synthetic oligonucleotide
guuucuucaucauuugccccaga

SEQ ID NO: 1648 - RNA, 21 nt, Artificial Sequence
  Description of Artificial Sequence: Synthetic oligonucleotide
cuggggcaaaugaugaagaaa

SEQ ID NO: 1649 - RNA, 23 nt, Artificial Sequence
  Description of Artificial Sequence: Synthetic oligonucleotide
uuucuucaucauuugccccagac

SEQ ID NO: 1650 - RNA, 21 nt, Artificial Sequence
  Description of Artificial Sequence: Synthetic oligonucleotide
ccaaggcuguguuugugggga

SEQ ID NO: 1651 - RNA, 23 nt, Artificial Sequence
  Description of Artificial Sequence: Synthetic oligonucleotide
uccccacaaacacagccuuggcg

SEQ ID NO: 1652 - RNA, 21 nt, Artificial Sequence
  Description of Artificial Sequence: Synthetic oligonucleotide
caaggcuguguuuguggggag

SEQ ID NO: 1653 - RNA, 23 nt, Artificial Sequence
  Description of Artificial Sequence: Synthetic oligonucleotide
cuccccacaaacacagccuuggc

SEQ ID NO: 1654 - RNA, 21 nt, Artificial Sequence
  Description of Artificial Sequence: Synthetic oligonucleotide
ggcgccaaggcuguguuugug

SEQ ID NO: 1655 - RNA, 23 nt, Artificial Sequence
  Description of Artificial Sequence: Synthetic oligonucleotide
cacaaacacagccuuggcgccaa

SEQ ID NO: 1656 - RNA, 21 nt, Artificial Sequence
  Description of Artificial Sequence: Synthetic oligonucleotide
uggcgccaaggcuguguuugu

SEQ ID NO: 1657 - RNA, 23 nt, Artificial Sequence
  Description of Artificial Sequence: Synthetic oligonucleotide
acaaacacagccuuggcgccaag

SEQ ID NO: 1658 - RNA, 21 nt, Artificial Sequence
  Description of Artificial Sequence: Synthetic oligonucleotide
acugccgccacaacucaggau

SEQ ID NO: 1659 - RNA, 23 nt, Artificial Sequence
  Description of Artificial Sequence: Synthetic oligonucleotide
auccugaguuguggcggcaguuu

SEQ ID NO: 1660 - RNA, 21 nt, Artificial Sequence
  Description of Artificial Sequence: Synthetic oligonucleotide
cugccgccacaacucaggaug

SEQ ID NO: 1661 - RNA, 23 nt, Artificial Sequence
  Description of Artificial Sequence: Synthetic oligonucleotide
cauccugaguuguggcggcaguu

SEQ ID NO: 1662 - RNA, 21 nt, Artificial Sequence
  Description of Artificial Sequence: Synthetic oligonucleotide
ucaaacugccgccacaacuca

SEQ ID NO: 1663 - RNA, 23 nt, Artificial Sequence
  Description of Artificial Sequence: Synthetic oligonucleotide
ugaguuguggcggcaguuugaau

SEQ ID NO: 1664 - RNA, 21 nt, Artificial Sequence
  Description of Artificial Sequence: Synthetic oligonucleotide
uucaaacugccgccacaacuc

SEQ ID NO: 1665 - RNA, 23 nt, Artificial Sequence
  Description of Artificial Sequence: Synthetic oligonucleotide
gaguuguggcggcaguuugaauc

SEQ ID NO: 1666 - RNA, 21 nt, Artificial Sequence
  Description of Artificial Sequence: Synthetic oligonucleotide
gggaagauaucaaauggcuga

SEQ ID NO: 1667 - RNA, 23 nt, Artificial Sequence
  Description of Artificial Sequence: Synthetic oligonucleotide
ucagccauuugauaucuucccag

SEQ ID NO: 1668 - RNA, 21 nt, Artificial Sequence
  Description of Artificial Sequence: Synthetic oligonucleotide
ggaagauaucaaauggcugag

SEQ ID NO: 1669 - RNA, 23 nt, Artificial Sequence
  Description of Artificial Sequence: Synthetic oligonucleotide
cucagccauuugauaucuuccca

SEQ ID NO: 1670 - RNA, 21 nt, Artificial Sequence
  Description of Artificial Sequence: Synthetic oligonucleotide
agcugggaagauaucaaaugg

SEQ ID NO: 1671 - RNA, 23 nt, Artificial Sequence
  Description of Artificial Sequence: Synthetic oligonucleotide
ccauuugauaucuucccagcuga

SEQ ID NO: 1672 - RNA, 21 nt, Artificial Sequence
  Description of Artificial Sequence: Synthetic oligonucleotide
cagcugggaagauaucaaaug

SEQ ID NO: 1673 - RNA, 23 nt, Artificial Sequence
  Description of Artificial Sequence: Synthetic oligonucleotide
cauuugauaucuucccagcugau

SEQ ID NO: 1674 - RNA, 21 nt, Artificial Sequence
  Description of Artificial Sequence: Synthetic oligonucleotide
aaucaguacuuccaaagucua

SEQ ID NO: 1675 - RNA, 23 nt, Artificial Sequence
  Description of Artificial Sequence: Synthetic oligonucleotide
uagacuuuggaaguacugauuua

SEQ ID NO: 1676 - RNA, 21 nt, Artificial Sequence
  Description of Artificial Sequence: Synthetic oligonucleotide
aucaguacuuccaaagucuau

SEQ ID NO: 1677 - RNA, 23 nt, Artificial Sequence
  Description of Artificial Sequence: Synthetic oligonucleotide
auagacuuuggaaguacugauuu

SEQ ID NO: 1678 - RNA, 21 nt, Artificial Sequence
  Description of Artificial Sequence: Synthetic oligonucleotide
gcuaaaucaguacuuccaaag

SEQ ID NO: 1679 - RNA, 23 nt, Artificial Sequence
  Description of Artificial Sequence: Synthetic oligonucleotide
cuuuggaaguacugauuuagcau

SEQ ID NO: 1680 - RNA, 21 nt, Artificial Sequence
  Description of Artificial Sequence: Synthetic oligonucleotide
ugcuaaaucaguacuuccaaa

SEQ ID NO: 1681 - RNA, 23 nt, Artificial Sequence
  Description of Artificial Sequence: Synthetic oligonucleotide
uuuggaaguacugauuuagcaug

SEQ ID NO: 1682 - RNA, 21 nt, Artificial Sequence
  Description of Artificial Sequence: Synthetic oligonucleotide
ucagcaugccaauaugugugg

SEQ ID NO: 1683 - RNA, 23 nt, Artificial Sequence
  Description of Artificial Sequence: Synthetic oligonucleotide
ccacacauauuggcaugcugacc

SEQ ID NO: 1684 - RNA, 21 nt, Artificial Sequence
  Description of Artificial Sequence: Synthetic oligonucleotide
cagcaugccaauauguguggg

SEQ ID NO: 1685 - RNA, 23 nt, Artificial Sequence
  Description of Artificial Sequence: Synthetic oligonucleotide
cccacacauauuggcaugcugac

SEQ ID NO: 1686 - RNA, 21 nt, Artificial Sequence
  Description of Artificial Sequence: Synthetic oligonucleotide
agggucagcaugccaauaugu

SEQ ID NO: 1687 - RNA, 23 nt, Artificial Sequence
  Description of Artificial Sequence: Synthetic oligonucleotide
acauauuggcaugcugacccucu

SEQ ID NO: 1688 - RNA, 21 nt, Artificial Sequence
  Description of Artificial Sequence: Synthetic oligonucleotide
gagggucagcaugccaauaug

SEQ ID NO: 1689 - RNA, 23 nt, Artificial Sequence
  Description of Artificial Sequence: Synthetic oligonucleotide
cauauuggcaugcugacccucug

SEQ ID NO: 1690 - RNA, 21 nt, Artificial Sequence
  Description of Artificial Sequence: Synthetic oligonucleotide
gcauauguggcuaaagcaaua

SEQ ID NO: 1691 - RNA, 23 nt, Artificial Sequence
  Description of Artificial Sequence: Synthetic oligonucleotide
uauugcuuuagccacauaugcag

SEQ ID NO: 1692 - RNA, 21 nt, Artificial Sequence
  Description of Artificial Sequence: Synthetic oligonucleotide
cauauguggcuaaagcaauag

SEQ ID NO: 1693 - RNA, 23 nt, Artificial Sequence
  Description of Artificial Sequence: Synthetic oligonucleotide
cuauugcuuuagccacauaugca

SEQ ID NO: 1694 - RNA, 21 nt, Artificial Sequence
  Description of Artificial Sequence: Synthetic oligonucleotide
ugcugcauauguggcuaaagc

SEQ ID NO: 1695 - RNA, 23 nt, Artificial Sequence
  Description of Artificial Sequence: Synthetic oligonucleotide
gcuuuagccacauaugcagcaag

SEQ ID NO: 1696 - RNA, 21 nt, Artificial Sequence
  Description of Artificial Sequence: Synthetic oligonucleotide
uugcugcauauguggcuaaag

SEQ ID NO: 1697 - RNA, 23 nt, Artificial Sequence
  Description of Artificial Sequence: Synthetic oligonucleotide
cuuuagccacauaugcagcaagu

SEQ ID NO: 1698 - RNA, 21 nt, Artificial Sequence
  Description of Artificial Sequence: Synthetic oligonucleotide
aaaugaugaagaaacuuuggc

SEQ ID NO: 1699 - RNA, 23 nt, Artificial Sequence
  Description of Artificial Sequence: Synthetic oligonucleotide
gccaaaguuucuucaucauuugc

SEQ ID NO: 1700 - RNA, 21 nt, Artificial Sequence
  Description of Artificial Sequence: Synthetic oligonucleotide
aaugaugaagaaacuuuggcu

SEQ ID NO: 1701 - RNA, 23 nt, Artificial Sequence
  Description of Artificial Sequence: Synthetic oligonucleotide
agccaaaguuucuucaucauuug

SEQ ID NO: 1702 - RNA, 21 nt, Artificial Sequence
  Description of Artificial Sequence: Synthetic oligonucleotide
gggcaaaugaugaagaaacuu

SEQ ID NO: 1703 - RNA, 23 nt, Artificial Sequence
  Description of Artificial Sequence: Synthetic oligonucleotide
aaguuucuucaucauuugcccca

SEQ ID NO: 1704 - RNA, 21 nt, Artificial Sequence
  Description of Artificial Sequence: Synthetic oligonucleotide
ggggcaaaugaugaagaaacu

SEQ ID NO: 1705 - RNA, 23 nt, Artificial Sequence
  Description of Artificial Sequence: Synthetic oligonucleotide
aguuucuucaucauuugccccag

SEQ ID NO: 1706 - RNA, 21 nt, Artificial Sequence
  Description of Artificial Sequence: Synthetic oligonucleotide
gagauacuaaaggaagaauuc

SEQ ID NO: 1707 - RNA, 23 nt, Artificial Sequence
  Description of Artificial Sequence: Synthetic oligonucleotide
gaauucuuccuuuaguaucucga

SEQ ID NO: 1708 - RNA, 21 nt, Artificial Sequence
  Description of Artificial Sequence: Synthetic oligonucleotide
agauacuaaaggaagaauucc

SEQ ID NO: 1709 - RNA, 23 nt, Artificial Sequence
  Description of Artificial Sequence: Synthetic oligonucleotide
ggaauucuuccuuuaguaucucg

SEQ ID NO: 1710 - RNA, 21 nt, Artificial Sequence
  Description of Artificial Sequence: Synthetic oligonucleotide
ccucgagauacuaaaggaaga

SEQ ID NO: 1711 - RNA, 23 nt, Artificial Sequence
  Description of Artificial Sequence: Synthetic oligonucleotide
ucuuccuuuaguaucucgaggac

SEQ ID NO: 1712 - RNA, 21 nt, Artificial Sequence
  Description of Artificial Sequence: Synthetic oligonucleotide
uccucgagauacuaaaggaag

SEQ ID NO: 1713 - RNA, 23 nt, Artificial Sequence
  Description of Artificial Sequence: Synthetic oligonucleotide
cuuccuuuaguaucucgaggaca

SEQ ID NO: 1714 - RNA, 21 nt, Artificial Sequence
  Description of Artificial Sequence: Synthetic oligonucleotide
acaacucaggaugaaaaauuu

SEQ ID NO: 1715 - RNA, 23 nt, Artificial Sequence
  Description of Artificial Sequence: Synthetic oligonucleotide
aaauuuuucauccugaguugugg

SEQ ID NO: 1716 - RNA, 21 nt, Artificial Sequence
  Description of Artificial Sequence: Synthetic oligonucleotide
caacucaggaugaaaaauuuu

SEQ ID NO: 1717 - RNA, 23 nt, Artificial Sequence
  Description of Artificial Sequence: Synthetic oligonucleotide
aaaauuuuucauccugaguugug

SEQ ID NO: 1718 - RNA, 21 nt, Artificial Sequence
  Description of Artificial Sequence: Synthetic oligonucleotide
cgccacaacucaggaugaaaa

SEQ ID NO: 1719 - RNA, 23 nt, Artificial Sequence
  Description of Artificial Sequence: Synthetic oligonucleotide
uuuucauccugaguuguggcggc

SEQ ID NO: 1720 - RNA, 21 nt, Artificial Sequence
  Description of Artificial Sequence: Synthetic oligonucleotide
ccgccacaacucaggaugaaa

SEQ ID NO: 1721 - RNA, 23 nt, Artificial Sequence
  Description of Artificial Sequence: Synthetic oligonucleotide
uuucauccugaguuguggcggca

SEQ ID NO: 1722 - RNA, 21 nt, Artificial Sequence
  Description of Artificial Sequence: Synthetic oligonucleotide
agggaagguggaagucuuccu

SEQ ID NO: 1723 - RNA, 23 nt, Artificial Sequence
  Description of Artificial Sequence: Synthetic oligonucleotide
aggaagacuuccaccuucccuuc

SEQ ID NO: 1724 - RNA, 21 nt, Artificial Sequence
  Description of Artificial Sequence: Synthetic oligonucleotide
gggaagguggaagucuuccug

SEQ ID NO: 1725 - RNA, 23 nt, Artificial Sequence
  Description of Artificial Sequence: Synthetic oligonucleotide
caggaagacuuccaccuucccuu

SEQ ID NO: 1726 - RNA, 21 nt, Artificial Sequence
  Description of Artificial Sequence: Synthetic oligonucleotide
uggaagggaagguggaagucu

SEQ ID NO: 1727 - RNA, 23 nt, Artificial Sequence
  Description of Artificial Sequence: Synthetic oligonucleotide
agacuuccaccuucccuuccaca

SEQ ID NO: 1728 - RNA, 21 nt, Artificial Sequence
  Description of Artificial Sequence: Synthetic oligonucleotide
guggaagggaagguggaaguc

SEQ ID NO: 1729 - RNA, 23 nt, Artificial Sequence
  Description of Artificial Sequence: Synthetic oligonucleotide
gacuuccaccuucccuuccacag

SEQ ID NO: 1730 - RNA, 21 nt, Artificial Sequence
  Description of Artificial Sequence: Synthetic oligonucleotide
ggcgagcuugccacugugaga

SEQ ID NO: 1731 - RNA, 23 nt, Artificial Sequence
  Description of Artificial Sequence: Synthetic oligonucleotide
ucucacaguggcaagcucgccgu

SEQ ID NO: 1732 - RNA, 21 nt, Artificial Sequence
  Description of Artificial Sequence: Synthetic oligonucleotide
gcgagcuugccacugugagag

SEQ ID NO: 1733 - RNA, 23 nt, Artificial Sequence
  Description of Artificial Sequence: Synthetic oligonucleotide
cucucacaguggcaagcucgccg

SEQ ID NO: 1734 - RNA, 21 nt, Artificial Sequence
  Description of Artificial Sequence: Synthetic oligonucleotide
ggacggcgagcuugccacugu

SEQ ID NO: 1735 - RNA, 23 nt, Artificial Sequence
  Description of Artificial Sequence: Synthetic oligonucleotide
acaguggcaagcucgccguccac

SEQ ID NO: 1736 - RNA, 21 nt, Artificial Sequence
  Description of Artificial Sequence: Synthetic oligonucleotide
uggacggcgagcuugccacug

SEQ ID NO: 1737 - RNA, 23 nt, Artificial Sequence
  Description of Artificial Sequence: Synthetic oligonucleotide
caguggcaagcucgccguccaca

SEQ ID NO: 1738 - RNA, 21 nt, Artificial Sequence
  Description of Artificial Sequence: Synthetic oligonucleotide
augugcguaacagauucaaac

SEQ ID NO: 1739 - RNA, 23 nt, Artificial Sequence
  Description of Artificial Sequence: Synthetic oligonucleotide
guuugaaucuguuacgcacauca

SEQ ID NO: 1740 - RNA, 21 nt, Artificial Sequence
  Description of Artificial Sequence: Synthetic oligonucleotide
ugugcguaacagauucaaacu

SEQ ID NO: 1741 - RNA, 23 nt, Artificial Sequence
  Description of Artificial Sequence: Synthetic oligonucleotide
aguuugaaucuguuacgcacauc

SEQ ID NO: 1742 - RNA, 21 nt, Artificial Sequence
  Description of Artificial Sequence: Synthetic oligonucleotide
gaugaugugcguaacagauuc

SEQ ID NO: 1743 - RNA, 23 nt, Artificial Sequence
  Description of Artificial Sequence: Synthetic oligonucleotide
gaaucuguuacgcacaucaucca

SEQ ID NO: 1744 - RNA, 21 nt, Artificial Sequence
  Description of Artificial Sequence: Synthetic oligonucleotide
ggaugaugugcguaacagauu

SEQ ID NO: 1745 - RNA, 23 nt, Artificial Sequence
  Description of Artificial Sequence: Synthetic oligonucleotide
aaucuguuacgcacaucauccag

SEQ ID NO: 1746 - RNA, 21 nt, Artificial Sequence
  Description of Artificial Sequence: Synthetic oligonucleotide
gggucagcaugccaauaugug

SEQ ID NO: 1747 - RNA, 23 nt, Artificial Sequence
  Description of Artificial Sequence: Synthetic oligonucleotide
cacauauuggcaugcugacccuc

SEQ ID NO: 1748 - RNA, 21 nt, Artificial Sequence
  Description of Artificial Sequence: Synthetic oligonucleotide
ggucagcaugccaauaugugu

SEQ ID NO: 1749 - RNA, 23 nt, Artificial Sequence
  Description of Artificial Sequence: Synthetic oligonucleotide
acacauauuggcaugcugacccu

SEQ ID NO: 1750 - RNA, 21 nt, Artificial Sequence
  Description of Artificial Sequence: Synthetic oligonucleotide
cagagggucagcaugccaaua

SEQ ID NO: 1751 - RNA, 23 nt, Artificial Sequence
  Description of Artificial Sequence: Synthetic oligonucleotide
uauuggcaugcugacccucuguc

SEQ ID NO: 1752 - RNA, 21 nt, Artificial Sequence
  Description of Artificial Sequence: Synthetic oligonucleotide
acagagggucagcaugccaau

SEQ ID NO: 1753 - RNA, 23 nt, Artificial Sequence
  Description of Artificial Sequence: Synthetic oligonucleotide
auuggcaugcugacccucugucc

SEQ ID NO: 1754 - RNA, 21 nt, Artificial Sequence
  Description of Artificial Sequence: Synthetic oligonucleotide
gcuugaaugggaucuuggugu

SEQ ID NO: 1755 - RNA, 23 nt, Artificial Sequence
  Description of Artificial Sequence: Synthetic oligonucleotide
acaccaagaucccauucaagcca

SEQ ID NO: 1756 - RNA, 21 nt, Artificial Sequence
  Description of Artificial Sequence: Synthetic oligonucleotide
cuugaaugggaucuugguguc

SEQ ID NO: 1757 - RNA, 23 nt, Artificial Sequence
  Description of Artificial Sequence: Synthetic oligonucleotide
gacaccaagaucccauucaagcc

SEQ ID NO: 1758 - RNA, 21 nt, Artificial Sequence
  Description of Artificial Sequence: Synthetic oligonucleotide
cauggcuugaaugggaucuug

SEQ ID NO: 1759 - RNA, 23 nt, Artificial Sequence
  Description of Artificial Sequence: Synthetic oligonucleotide
caagaucccauucaagccauguu

SEQ ID NO: 1760 - RNA, 21 nt, Artificial Sequence
  Description of Artificial Sequence: Synthetic oligonucleotide
acauggcuugaaugggaucuu

SEQ ID NO: 1761 - RNA, 23 nt, Artificial Sequence
  Description of Artificial Sequence: Synthetic oligonucleotide
aagaucccauucaagccauguuu

SEQ ID NO: 1762 - RNA, 21 nt, Artificial Sequence
  Description of Artificial Sequence: Synthetic oligonucleotide
ucaaauggcugagaagacuga

SEQ ID NO: 1763 - RNA, 23 nt, Artificial Sequence
  Description of Artificial Sequence: Synthetic oligonucleotide
ucagucuucucagccauuugaua

SEQ ID NO: 1764 - RNA, 21 nt, Artificial Sequence
  Description of Artificial Sequence: Synthetic oligonucleotide
caaauggcugagaagacugac

SEQ ID NO: 1765 - RNA, 23 nt, Artificial Sequence
  Description of Artificial Sequence: Synthetic oligonucleotide
gucagucuucucagccauuugau

SEQ ID NO: 1766 - RNA, 21 nt, Artificial Sequence
  Description of Artificial Sequence: Synthetic oligonucleotide
gauaucaaauggcugagaaga

SEQ ID NO: 1767 - RNA, 23 nt, Artificial Sequence
  Description of Artificial Sequence: Synthetic oligonucleotide
ucuucucagccauuugauaucuu

SEQ ID NO: 1768 - RNA, 21 nt, Artificial Sequence
  Description of Artificial Sequence: Synthetic oligonucleotide
agauaucaaauggcugagaag

SEQ ID NO: 1769 - RNA, 23 nt, Artificial Sequence
  Description of Artificial Sequence: Synthetic oligonucleotide
cuucucagccauuugauaucuuc

SEQ ID NO: 1770 - RNA, 21 nt, Artificial Sequence
  Description of Artificial Sequence: Synthetic oligonucleotide
gaaagucaucgacaagacauu

SEQ ID NO: 1771 - RNA, 23 nt, Artificial Sequence
  Description of Artificial Sequence: Synthetic oligonucleotide
aaugucuugucgaugacuuucac

SEQ ID NO: 1772 - RNA, 21 nt, Artificial Sequence
  Description of Artificial Sequence: Synthetic oligonucleotide
aaagucaucgacaagacauug

SEQ ID NO: 1773 - RNA, 23 nt, Artificial Sequence
  Description of Artificial Sequence: Synthetic oligonucleotide
caaugucuugucgaugacuuuca

SEQ ID NO: 1774 - RNA, 21 nt, Artificial Sequence
  Description of Artificial Sequence: Synthetic oligonucleotide
augugaaagucaucgacaaga

SEQ ID NO: 1775 - RNA, 23 nt, Artificial Sequence
  Description of Artificial Sequence: Synthetic oligonucleotide
ucuugucgaugacuuucacauuc

SEQ ID NO: 1776 - RNA, 21 nt, Artificial Sequence
  Description of Artificial Sequence: Synthetic oligonucleotide
aaugugaaagucaucgacaag

SEQ ID NO: 1777 - RNA, 23 nt, Artificial Sequence
  Description of Artificial Sequence: Synthetic oligonucleotide
cuugucgaugacuuucacauucu

SEQ ID NO: 1778 - RNA, 21 nt, Artificial Sequence
  Description of Artificial Sequence: Synthetic oligonucleotide
ggcuaauuuguaucaaugauu

SEQ ID NO: 1779 - RNA, 23 nt, Artificial Sequence
  Description of Artificial Sequence: Synthetic oligonucleotide
aaucauugauacaaauuagccgg

SEQ ID NO: 1780 - RNA, 21 nt, Artificial Sequence
  Description of Artificial Sequence: Synthetic oligonucleotide
gcuaauuuguaucaaugauua

SEQ ID NO: 1781 - RNA, 23 nt, Artificial Sequence
  Description of Artificial Sequence: Synthetic oligonucleotide
uaaucauugauacaaauuagccg

SEQ ID NO: 1782 - RNA, 21 nt, Artificial Sequence
  Description of Artificial Sequence: Synthetic oligonucleotide
ccccggcuaauuuguaucaau

SEQ ID NO: 1783 - RNA, 23 nt, Artificial Sequence
  Description of Artificial Sequence: Synthetic oligonucleotide
auugauacaaauuagccggggga

SEQ ID NO: 1784 - RNA, 21 nt, Artificial Sequence
  Description of Artificial Sequence: Synthetic oligonucleotide
cccccggcuaauuuguaucaa

SEQ ID NO: 1785 - RNA, 23 nt, Artificial Sequence
  Description of Artificial Sequence: Synthetic oligonucleotide
uugauacaaauuagccgggggag

SEQ ID NO: 1786 - RNA, 21 nt, Artificial Sequence
  Description of Artificial Sequence: Synthetic oligonucleotide
ugucgacuucuguuuuaggac

SEQ ID NO: 1787 - RNA, 23 nt, Artificial Sequence
  Description of Artificial Sequence: Synthetic oligonucleotide
guccuaaaacagaagucgacaga

SEQ ID NO: 1788 - RNA, 21 nt, Artificial Sequence
  Description of Artificial Sequence: Synthetic oligonucleotide
gucgacuucuguuuuaggaca

SEQ ID NO: 1789 - RNA, 23 nt, Artificial Sequence
  Description of Artificial Sequence: Synthetic oligonucleotide
uguccuaaaacagaagucgacag

SEQ ID NO: 1790 - RNA, 21 nt, Artificial Sequence
  Description of Artificial Sequence: Synthetic oligonucleotide
gaucugucgacuucuguuuua

SEQ ID NO: 1791 - RNA, 23 nt, Artificial Sequence
  Description of Artificial Sequence: Synthetic oligonucleotide
uaaaacagaagucgacagaucug

SEQ ID NO: 1792 - RNA, 21 nt, Artificial Sequence
  Description of Artificial Sequence: Synthetic oligonucleotide
agaucugucgacuucuguuuu

SEQ ID NO: 1793 - RNA, 23 nt, Artificial Sequence
  Description of Artificial Sequence: Synthetic oligonucleotide
aaaacagaagucgacagaucugu

SEQ ID NO: 1794 - RNA, 21 nt, Artificial Sequence
  Description of Artificial Sequence: Synthetic oligonucleotide
ccgagaagucaccaagaagcu

SEQ ID NO: 1795 - RNA, 23 nt, Artificial Sequence
  Description of Artificial Sequence: Synthetic oligonucleotide
agcuucuuggugacuucucgguc

SEQ ID NO: 1796 - RNA, 21 nt, Artificial Sequence
  Description of Artificial Sequence: Synthetic oligonucleotide
cgagaagucaccaagaagcua

SEQ ID NO: 1797 - RNA, 23 nt, Artificial Sequence
  Description of Artificial Sequence: Synthetic oligonucleotide
uagcuucuuggugacuucucggu

SEQ ID NO: 1798 - RNA, 21 nt, Artificial Sequence
  Description of Artificial Sequence: Synthetic oligonucleotide
aggaccgagaagucaccaaga

SEQ ID NO: 1799 - RNA, 23 nt, Artificial Sequence
  Description of Artificial Sequence: Synthetic oligonucleotide
ucuuggugacuucucgguccuug

SEQ ID NO: 1800 - RNA, 21 nt, Artificial Sequence
  Description of Artificial Sequence: Synthetic oligonucleotide
aaggaccgagaagucaccaag

SEQ ID NO: 1801 - RNA, 23 nt, Artificial Sequence
  Description of Artificial Sequence: Synthetic oligonucleotide
cuuggugacuucucgguccuugu

SEQ ID NO: 1802 - RNA, 21 nt, Artificial Sequence
  Description of Artificial Sequence: Synthetic oligonucleotide
aaacauggcuugaaugggauc

SEQ ID NO: 1803 - RNA, 23 nt, Artificial Sequence
  Description of Artificial Sequence: Synthetic oligonucleotide
gaucccauucaagccauguuuaa

SEQ ID NO: 1804 - RNA, 21 nt, Artificial Sequence
  Description of Artificial Sequence: Synthetic oligonucleotide
aacauggcuugaaugggaucu

SEQ ID NO: 1805 - RNA, 23 nt, Artificial Sequence
  Description of Artificial Sequence: Synthetic oligonucleotide
agaucccauucaagccauguuua

SEQ ID NO: 1806 - RNA, 21 nt, Artificial Sequence
  Description of Artificial Sequence: Synthetic oligonucleotide
uguuaaacauggcuugaaugg

SEQ ID NO: 1807 - RNA, 23 nt, Artificial Sequence
  Description of Artificial Sequence: Synthetic oligonucleotide
ccauucaagccauguuuaacagc

SEQ ID NO: 1808 - RNA, 21 nt, Artificial Sequence
  Description of Artificial Sequence: Synthetic oligonucleotide
cuguuaaacauggcuugaaug

SEQ ID NO: 1809 - RNA, 23 nt, Artificial Sequence
  Description of Artificial Sequence: Synthetic oligonucleotide
cauucaagccauguuuaacagcc

SEQ ID NO: 1810 - RNA, 21 nt, Artificial Sequence
  Description of Artificial Sequence: Synthetic oligonucleotide
gacuugcugcauauguggcua

SEQ ID NO: 1811 - RNA, 23 nt, Artificial Sequence
  Description of Artificial Sequence: Synthetic oligonucleotide
uagccacauaugcagcaagucca

SEQ ID NO: 1812 - RNA, 21 nt, Artificial Sequence
  Description of Artificial Sequence: Synthetic oligonucleotide
acuugcugcauauguggcuaa

SEQ ID NO: 1813 - RNA, 23 nt, Artificial Sequence
  Description of Artificial Sequence: Synthetic oligonucleotide
uuagccacauaugcagcaagucc

SEQ ID NO: 1814 - RNA, 21 nt, Artificial Sequence
  Description of Artificial Sequence: Synthetic oligonucleotide
aguggacuugcugcauaugug

SEQ ID NO: 1815 - RNA, 23 nt, Artificial Sequence
  Description of Artificial Sequence: Synthetic oligonucleotide
cacauaugcagcaaguccacugu

SEQ ID NO: 1816 - RNA, 21 nt, Artificial Sequence
  Description of Artificial Sequence: Synthetic oligonucleotide
caguggacuugcugcauaugu

SEQ ID NO: 1817 - RNA, 23 nt, Artificial Sequence
  Description of Artificial Sequence: Synthetic oligonucleotide
acauaugcagcaaguccacuguc

SEQ ID NO: 1818 - RNA, 21 nt, Artificial Sequence
  Description of Artificial Sequence: Synthetic oligonucleotide
uaaaucaguacuuccaaaguc

SEQ ID NO: 1819 - RNA, 23 nt, Artificial Sequence
  Description of Artificial Sequence: Synthetic oligonucleotide
gacuuuggaaguacugauuuagc

SEQ ID NO: 1820 - RNA, 21 nt, Artificial Sequence
  Description of Artificial Sequence: Synthetic oligonucleotide
aaaucaguacuuccaaagucu

SEQ ID NO: 1821 - RNA, 23 nt, Artificial Sequence
  Description of Artificial Sequence: Synthetic oligonucleotide
agacuuuggaaguacugauuuag

SEQ ID NO: 1822 - RNA, 21 nt, Artificial Sequence
  Description of Artificial Sequence: Synthetic oligonucleotide
augcuaaaucaguacuuccaa

SEQ ID NO: 1823 - RNA, 23 nt, Artificial Sequence
  Description of Artificial Sequence: Synthetic oligonucleotide
uuggaaguacugauuuagcaugu

SEQ ID NO: 1824 - RNA, 21 nt, Artificial Sequence
  Description of Artificial Sequence: Synthetic oligonucleotide
caugcuaaaucaguacuucca

SEQ ID NO: 1825 - RNA, 23 nt, Artificial Sequence
  Description of Artificial Sequence: Synthetic oligonucleotide
uggaaguacugauuuagcauguu

SEQ ID NO: 1826 - RNA, 21 nt, Artificial Sequence
  Description of Artificial Sequence: Synthetic oligonucleotide
uccucaauugaagaaguggcg

SEQ ID NO: 1827 - RNA, 23 nt, Artificial Sequence
  Description of Artificial Sequence: Synthetic oligonucleotide
cgccacuucuucaauugaggagg

SEQ ID NO: 1828 - RNA, 21 nt, Artificial Sequence
  Description of Artificial Sequence: Synthetic oligonucleotide
ccucaauugaagaaguggcgg

SEQ ID NO: 1829 - RNA, 23 nt, Artificial Sequence
  Description of Artificial Sequence: Synthetic oligonucleotide
ccgccacuucuucaauugaggag

SEQ ID NO: 1830 - RNA, 21 nt, Artificial Sequence
  Description of Artificial Sequence: Synthetic oligonucleotide
caccuccucaauugaagaagu

SEQ ID NO: 1831 - RNA, 23 nt, Artificial Sequence
  Description of Artificial Sequence: Synthetic oligonucleotide
acuucuucaauugaggagguggc

SEQ ID NO: 1832 - RNA, 21 nt, Artificial Sequence
  Description of Artificial Sequence: Synthetic oligonucleotide
ccaccuccucaauugaagaag

SEQ ID NO: 1833 - RNA, 23 nt, Artificial Sequence
  Description of Artificial Sequence: Synthetic oligonucleotide
cuucuucaauugaggagguggcc

SEQ ID NO: 1834 - RNA, 21 nt, Artificial Sequence
  Description of Artificial Sequence: Synthetic oligonucleotide
caagauguccucgagauacua

SEQ ID NO: 1835 - RNA, 23 nt, Artificial Sequence
  Description of Artificial Sequence: Synthetic oligonucleotide
uaguaucucgaggacaucuugaa

SEQ ID NO: 1836 - RNA, 21 nt, Artificial Sequence
  Description of Artificial Sequence: Synthetic oligonucleotide
aagauguccucgagauacuaa

SEQ ID NO: 1837 - RNA, 23 nt, Artificial Sequence
  Description of Artificial Sequence: Synthetic oligonucleotide
uuaguaucucgaggacaucuuga

SEQ ID NO: 1838 - RNA, 21 nt, Artificial Sequence
  Description of Artificial Sequence: Synthetic oligonucleotide
uguucaagauguccucgagau

SEQ ID NO: 1839 - RNA, 23 nt, Artificial Sequence
  Description of Artificial Sequence: Synthetic oligonucleotide
aucucgaggacaucuugaacacc

SEQ ID NO: 1840 - RNA, 21 nt, Artificial Sequence
  Description of Artificial Sequence: Synthetic oligonucleotide
guguucaagauguccucgaga

SEQ ID NO: 1841 - RNA, 23 nt, Artificial Sequence
  Description of Artificial Sequence: Synthetic oligonucleotide
ucucgaggacaucuugaacaccu

SEQ ID NO: 1842 - RNA, 21 nt, Artificial Sequence
  Description of Artificial Sequence: Synthetic oligonucleotide
acaugcuaaaucaguacuucc

SEQ ID NO: 1843 - RNA, 23 nt, Artificial Sequence
  Description of Artificial Sequence: Synthetic oligonucleotide
ggaaguacugauuuagcauguug

SEQ ID NO: 1844 - RNA, 21 nt, Artificial Sequence
  Description of Artificial Sequence: Synthetic oligonucleotide
caugcuaaaucaguacuucca

SEQ ID NO: 1845 - RNA, 23 nt, Artificial Sequence
  Description of Artificial Sequence: Synthetic oligonucleotide
uggaaguacugauuuagcauguu

SEQ ID NO: 1846 - RNA, 21 nt, Artificial Sequence
  Description of Artificial Sequence: Synthetic oligonucleotide
aacaacaugcuaaaucaguac

SEQ ID NO: 1847 - RNA, 23 nt, Artificial Sequence
  Description of Artificial Sequence: Synthetic oligonucleotide
guacugauuuagcauguuguuca

SEQ ID NO: 1848 - RNA, 21 nt, Artificial Sequence
  Description of Artificial Sequence: Synthetic oligonucleotide
gaacaacaugcuaaaucagua

SEQ ID NO: 1849 - RNA, 23 nt, Artificial Sequence
  Description of Artificial Sequence: Synthetic oligonucleotide
uacugauuuagcauguuguucau

SEQ ID NO: 1850 - RNA, 21 nt, Artificial Sequence
  Description of Artificial Sequence: Synthetic oligonucleotide
gaaaggcacugauguucugaa

SEQ ID NO: 1851 - RNA, 23 nt, Artificial Sequence
  Description of Artificial Sequence: Synthetic oligonucleotide
uucagaacaucagugccuuuccg

SEQ ID NO: 1852 - RNA, 21 nt, Artificial Sequence
  Description of Artificial Sequence: Synthetic oligonucleotide
aaaggcacugauguucugaaa

SEQ ID NO: 1853 - RNA, 23 nt, Artificial Sequence
  Description of Artificial Sequence: Synthetic oligonucleotide
uuucagaacaucagugccuuucc

SEQ ID NO: 1854 - RNA, 21 nt, Artificial Sequence
  Description of Artificial Sequence: Synthetic oligonucleotide
ugcggaaaggcacugauguuc

SEQ ID NO: 1855 - RNA, 23 nt, Artificial Sequence
  Description of Artificial Sequence: Synthetic oligonucleotide
gaacaucagugccuuuccgcaca

SEQ ID NO: 1856 - RNA, 21 nt, Artificial Sequence
  Description of Artificial Sequence: Synthetic oligonucleotide
gugcggaaaggcacugauguu

SEQ ID NO: 1857 - RNA, 23 nt, Artificial Sequence
  Description of Artificial Sequence: Synthetic oligonucleotide
aacaucagugccuuuccgcacac

SEQ ID NO: 1858 - RNA, 21 nt, Artificial Sequence
  Description of Artificial Sequence: Synthetic oligonucleotide
gucagcaugccaauaugugug

SEQ ID NO: 1859 - RNA, 23 nt, Artificial Sequence
  Description of Artificial Sequence: Synthetic oligonucleotide
cacacauauuggcaugcugaccc

SEQ ID NO: 1860 - RNA, 21 nt, Artificial Sequence
  Description of Artificial Sequence: Synthetic oligonucleotide
ucagcaugccaauaugugugg

SEQ ID NO: 1861 - RNA, 23 nt, Artificial Sequence
  Description of Artificial Sequence: Synthetic oligonucleotide
ccacacauauuggcaugcugacc

SEQ ID NO: 1862 - RNA, 21 nt, Artificial Sequence
  Description of Artificial Sequence: Synthetic oligonucleotide
gagggucagcaugccaauaug

SEQ ID NO: 1863 - RNA, 23 nt, Artificial Sequence
  Description of Artificial Sequence: Synthetic oligonucleotide
cauauuggcaugcugacccucug

SEQ ID NO: 1864 - RNA, 21 nt, Artificial Sequence
  Description of Artificial Sequence: Synthetic oligonucleotide
agagggucagcaugccaauau

SEQ ID NO: 1865 - RNA, 23 nt, Artificial Sequence
  Description of Artificial Sequence: Synthetic oligonucleotide
auauuggcaugcugacccucugu

SEQ ID NO: 1866 - RNA, 21 nt, Artificial Sequence
  Description of Artificial Sequence: Synthetic oligonucleotide
gaugcuccggaauguugcuga

SEQ ID NO: 1867 - RNA, 23 nt, Artificial Sequence
  Description of Artificial Sequence: Synthetic oligonucleotide
ucagcaacauuccggagcauccu

SEQ ID NO: 1868 - RNA, 21 nt, Artificial Sequence
  Description of Artificial Sequence: Synthetic oligonucleotide
augcuccggaauguugcugaa

SEQ ID NO: 1869 - RNA, 23 nt, Artificial Sequence
  Description of Artificial Sequence: Synthetic oligonucleotide
uucagcaacauuccggagcaucc

SEQ ID NO: 1870 - RNA, 21 nt, Artificial Sequence
  Description of Artificial Sequence: Synthetic oligonucleotide
caaggaugcuccggaauguug

SEQ ID NO: 1871 - RNA, 23 nt, Artificial Sequence
  Description of Artificial Sequence: Synthetic oligonucleotide
caacauuccggagcauccuugga

SEQ ID NO: 1872 - RNA, 21 nt, Artificial Sequence
  Description of Artificial Sequence: Synthetic oligonucleotide
ccaaggaugcuccggaauguu

SEQ ID NO: 1873 - RNA, 23 nt, Artificial Sequence
  Description of Artificial Sequence: Synthetic oligonucleotide
aacauuccggagcauccuuggau

SEQ ID NO: 1874 - RNA, 21 nt, Artificial Sequence
  Description of Artificial Sequence: Synthetic oligonucleotide
gcguaacagauucaaacugcc

SEQ ID NO: 1875 - RNA, 23 nt, Artificial Sequence
  Description of Artificial Sequence: Synthetic oligonucleotide
ggcaguuugaaucuguuacgcac

SEQ ID NO: 1876 - RNA, 21 nt, Artificial Sequence
  Description of Artificial Sequence: Synthetic oligonucleotide
cguaacagauucaaacugccg

SEQ ID NO: 1877 - RNA, 23 nt, Artificial Sequence
  Description of Artificial Sequence: Synthetic oligonucleotide
cggcaguuugaaucuguuacgca

SEQ ID NO: 1878 - RNA, 21 nt, Artificial Sequence
  Description of Artificial Sequence: Synthetic oligonucleotide
augugcguaacagauucaaac

SEQ ID NO: 1879 - RNA, 23 nt, Artificial Sequence
  Description of Artificial Sequence: Synthetic oligonucleotide
guuugaaucuguuacgcacauca

SEQ ID NO: 1880 - RNA, 21 nt, Artificial Sequence
  Description of Artificial Sequence: Synthetic oligonucleotide
gaugugcguaacagauucaaa

SEQ ID NO: 1881 - RNA, 23 nt, Artificial Sequence
  Description of Artificial Sequence: Synthetic oligonucleotide
uuugaaucuguuacgcacaucau

SEQ ID NO: 1882 - RNA, 21 nt, Artificial Sequence
  Description of Artificial Sequence: Synthetic oligonucleotide
agagaagaugggcuacaaggc

SEQ ID NO: 1883 - RNA, 23 nt, Artificial Sequence
  Description of Artificial Sequence: Synthetic oligonucleotide
gccuuguagcccaucuucucugc

SEQ ID NO: 1884 - RNA, 21 nt, Artificial Sequence
  Description of Artificial Sequence: Synthetic oligonucleotide
gagaagaugggcuacaaggcc

SEQ ID NO: 1885 - RNA, 23 nt, Artificial Sequence
  Description of Artificial Sequence: Synthetic oligonucleotide
ggccuuguagcccaucuucucug

SEQ ID NO: 1886 - RNA, 21 nt, Artificial Sequence
  Description of Artificial Sequence: Synthetic oligonucleotide
aggcagagaagaugggcuaca

SEQ ID NO: 1887 - RNA, 23 nt, Artificial Sequence
  Description of Artificial Sequence: Synthetic oligonucleotide
uguagcccaucuucucugccugc

SEQ ID NO: 1888 - RNA, 21 nt, Artificial Sequence
  Description of Artificial Sequence: Synthetic oligonucleotide
caggcagagaagaugggcuac

SEQ ID NO: 1889 - RNA, 23 nt, Artificial Sequence
  Description of Artificial Sequence: Synthetic oligonucleotide
guagcccaucuucucugccugcc

SEQ ID NO: 1890 - RNA, 21 nt, Artificial Sequence
  Description of Artificial Sequence: Synthetic oligonucleotide
auguauguuacuucuuagaga

SEQ ID NO: 1891 - RNA, 23 nt, Artificial Sequence
  Description of Artificial Sequence: Synthetic oligonucleotide
ucucuaagaaguaacauacaucc

SEQ ID NO: 1892 - RNA, 21 nt, Artificial Sequence
  Description of Artificial Sequence: Synthetic oligonucleotide
uguauguuacuucuuagagag

SEQ ID NO: 1893 - RNA, 23 nt, Artificial Sequence
  Description of Artificial Sequence: Synthetic oligonucleotide
cucucuaagaaguaacauacauc

SEQ ID NO: 1894 - RNA, 21 nt, Artificial Sequence
  Description of Artificial Sequence: Synthetic oligonucleotide
uaggauguauguuacuucuua

SEQ ID NO: 1895 - RNA, 23 nt, Artificial Sequence
  Description of Artificial Sequence: Synthetic oligonucleotide
uaagaaguaacauacauccuaaa

SEQ ID NO: 1896 - RNA, 21 nt, Artificial Sequence
  Description of Artificial Sequence: Synthetic oligonucleotide
uuaggauguauguuacuucuu

SEQ ID NO: 1897 - RNA, 23 nt, Artificial Sequence
  Description of Artificial Sequence: Synthetic oligonucleotide
aagaaguaacauacauccuaaaa

SEQ ID NO: 1898 - RNA, 21 nt, Artificial Sequence
  Description of Artificial Sequence: Synthetic oligonucleotide
agaaagguguucaagaugucc

SEQ ID NO: 1899 - RNA, 23 nt, Artificial Sequence
  Description of Artificial Sequence: Synthetic oligonucleotide
ggacaucuugaacaccuuucucc

SEQ ID NO: 1900 - RNA, 21 nt, Artificial Sequence
  Description of Artificial Sequence: Synthetic oligonucleotide
gaaagguguucaagauguccu

SEQ ID NO: 1901 - RNA, 23 nt, Artificial Sequence
  Description of Artificial Sequence: Synthetic oligonucleotide
aggacaucuugaacaccuuucuc

SEQ ID NO: 1902 - RNA, 21 nt, Artificial Sequence
  Description of Artificial Sequence: Synthetic oligonucleotide
ggggagaaagguguucaagau

SEQ ID NO: 1903 - RNA, 23 nt, Artificial Sequence
  Description of Artificial Sequence: Synthetic oligonucleotide
aucuugaacaccuuucucccccu

SEQ ID NO: 1904 - RNA, 21 nt, Artificial Sequence
  Description of Artificial Sequence: Synthetic oligonucleotide
gggggagaaagguguucaaga

SEQ ID NO: 1905 - RNA, 23 nt, Artificial Sequence
  Description of Artificial Sequence: Synthetic oligonucleotide
ucuugaacaccuuucucccccug

SEQ ID NO: 1906 - RNA, 21 nt, Artificial Sequence
  Description of Artificial Sequence: Synthetic oligonucleotide
agaaacuuuggcugauaauau

SEQ ID NO: 1907 - RNA, 23 nt, Artificial Sequence
  Description of Artificial Sequence: Synthetic oligonucleotide
auauuaucagccaaaguuucuuc

SEQ ID NO: 1908 - RNA, 21 nt, Artificial Sequence
  Description of Artificial Sequence: Synthetic oligonucleotide
gaaacuuuggcugauaauauu

SEQ ID NO: 1909 - RNA, 23 nt, Artificial Sequence
  Description of Artificial Sequence: Synthetic oligonucleotide
aauauuaucagccaaaguuucuu

SEQ ID NO: 1910 - RNA, 21 nt, Artificial Sequence
  Description of Artificial Sequence: Synthetic oligonucleotide
augaagaaacuuuggcugaua

SEQ ID NO: 1911 - RNA, 23 nt, Artificial Sequence
  Description of Artificial Sequence: Synthetic oligonucleotide
uaucagccaaaguuucuucauca

SEQ ID NO: 1912 - RNA, 21 nt, Artificial Sequence
  Description of Artificial Sequence: Synthetic oligonucleotide
gaugaagaaacuuuggcugau

SEQ ID NO: 1913 - RNA, 23 nt, Artificial Sequence
  Description of Artificial Sequence: Synthetic oligonucleotide
aucagccaaaguuucuucaucau

SEQ ID NO: 1914 - RNA, 21 nt, Artificial Sequence
  Description of Artificial Sequence: Synthetic oligonucleotide
aaggcacugauguucugaaag

SEQ ID NO: 1915 - RNA, 23 nt, Artificial Sequence
  Description of Artificial Sequence: Synthetic oligonucleotide
cuuucagaacaucagugccuuuc

SEQ ID NO: 1916 - RNA, 21 nt, Artificial Sequence
  Description of Artificial Sequence: Synthetic oligonucleotide
aggcacugauguucugaaagc

SEQ ID NO: 1917 - RNA, 23 nt, Artificial Sequence
  Description of Artificial Sequence: Synthetic oligonucleotide
gcuuucagaacaucagugccuuu

SEQ ID NO: 1918 - RNA, 21 nt, Artificial Sequence
  Description of Artificial Sequence: Synthetic oligonucleotide
cggaaaggcacugauguucug

SEQ ID NO: 1919 - RNA, 23 nt, Artificial Sequence
  Description of Artificial Sequence: Synthetic oligonucleotide
cagaacaucagugccuuuccgca

SEQ ID NO: 1920 - RNA, 21 nt, Artificial Sequence
  Description of Artificial Sequence: Synthetic oligonucleotide
gcggaaaggcacugauguucu

SEQ ID NO: 1921 - RNA, 23 nt, Artificial Sequence
  Description of Artificial Sequence: Synthetic oligonucleotide
agaacaucagugccuuuccgcac

SEQ ID NO: 1922 - RNA, 21 nt, Artificial Sequence
  Description of Artificial Sequence: Synthetic oligonucleotide
agaagacugacaucauugcca

SEQ ID NO: 1923 - RNA, 23 nt, Artificial Sequence
  Description of Artificial Sequence: Synthetic oligonucleotide
uggcaaugaugucagucuucuca

SEQ ID NO: 1924 - RNA, 21 nt, Artificial Sequence
  Description of Artificial Sequence: Synthetic oligonucleotide
gaagacugacaucauugccaa

SEQ ID NO: 1925 - RNA, 23 nt, Artificial Sequence
  Description of Artificial Sequence: Synthetic oligonucleotide
uuggcaaugaugucagucuucuc

SEQ ID NO: 1926 - RNA, 21 nt, Artificial Sequence
  Description of Artificial Sequence: Synthetic oligonucleotide
gcugagaagacugacaucauu

SEQ ID NO: 1927 - RNA, 23 nt, Artificial Sequence
  Description of Artificial Sequence: Synthetic oligonucleotide
aaugaugucagucuucucagcca

SEQ ID NO: 1928 - RNA, 21 nt, Artificial Sequence
  Description of Artificial Sequence: Synthetic oligonucleotide
ggcugagaagacugacaucau

SEQ ID NO: 1929 - RNA, 23 nt, Artificial Sequence
  Description of Artificial Sequence: Synthetic oligonucleotide
augaugucagucuucucagccau

SEQ ID NO: 1930 - RNA, 21 nt, Artificial Sequence
  Description of Artificial Sequence: Synthetic oligonucleotide
uaaugccugauucacaacuuu

SEQ ID NO: 1931 - RNA, 23 nt, Artificial Sequence
  Description of Artificial Sequence: Synthetic oligonucleotide
aaaguugugaaucaggcauuacc

SEQ ID NO: 1932 - RNA, 21 nt, Artificial Sequence
  Description of Artificial Sequence: Synthetic oligonucleotide
aaugccugauucacaacuuug

SEQ ID NO: 1933 - RNA, 23 nt, Artificial Sequence
  Description of Artificial Sequence: Synthetic oligonucleotide
caaaguugugaaucaggcauuac

SEQ ID NO: 1934 - RNA, 21 nt, Artificial Sequence
  Description of Artificial Sequence: Synthetic oligonucleotide
uugguaaugccugauucacaa

SEQ ID NO: 1935 - RNA, 23 nt, Artificial Sequence
  Description of Artificial Sequence: Synthetic oligonucleotide
uugugaaucaggcauuaccaaca

SEQ ID NO: 1936 - RNA, 21 nt, Artificial Sequence
  Description of Artificial Sequence: Synthetic oligonucleotide
guugguaaugccugauucaca

SEQ ID NO: 1937 - RNA, 23 nt, Artificial Sequence
  Description of Artificial Sequence: Synthetic oligonucleotide
ugugaaucaggcauuaccaacac

SEQ ID NO: 1938 - RNA, 21 nt, Artificial Sequence
  Description of Artificial Sequence: Synthetic oligonucleotide
uaucaaauggcugagaagacu

SEQ ID NO: 1939 - RNA, 23 nt, Artificial Sequence
  Description of Artificial Sequence: Synthetic oligonucleotide
agucuucucagccauuugauauc

SEQ ID NO: 1940 - RNA, 21 nt, Artificial Sequence
  Description of Artificial Sequence: Synthetic oligonucleotide
aucaaauggcugagaagacug

SEQ ID NO: 1941 - RNA, 23 nt, Artificial Sequence
  Description of Artificial Sequence: Synthetic oligonucleotide
cagucuucucagccauuugauau

SEQ ID NO: 1942 - RNA, 21 nt, Artificial Sequence
  Description of Artificial Sequence: Synthetic oligonucleotide
aagauaucaaauggcugagaa

SEQ ID NO: 1943 - RNA, 23 nt, Artificial Sequence
  Description of Artificial Sequence: Synthetic oligonucleotide
uucucagccauuugauaucuucc

SEQ ID NO: 1944 - RNA, 21 nt, Artificial Sequence
  Description of Artificial Sequence: Synthetic oligonucleotide
gaagauaucaaauggcugaga

SEQ ID NO: 1945 - RNA, 23 nt, Artificial Sequence
  Description of Artificial Sequence: Synthetic oligonucleotide
ucucagccauuugauaucuuccc

SEQ ID NO: 1946 - RNA, 21 nt, Artificial Sequence
  Description of Artificial Sequence: Synthetic oligonucleotide
ucugacagugcacaauauuuu

SEQ ID NO: 1947 - RNA, 23 nt, Artificial Sequence
  Description of Artificial Sequence: Synthetic oligonucleotide
aaaauauugugcacugucagauc

SEQ ID NO: 1948 - RNA, 21 nt, Artificial Sequence
  Description of Artificial Sequence: Synthetic oligonucleotide
cugacagugcacaauauuuuc

SEQ ID NO: 1949 - RNA, 23 nt, Artificial Sequence
  Description of Artificial Sequence: Synthetic oligonucleotide
gaaaauauugugcacugucagau

SEQ ID NO: 1950 - RNA, 21 nt, Artificial Sequence
  Description of Artificial Sequence: Synthetic oligonucleotide
aagaucugacagugcacaaua

SEQ ID NO: 1951 - RNA, 23 nt, Artificial Sequence
  Description of Artificial Sequence: Synthetic oligonucleotide
uauugugcacugucagaucuugg

SEQ ID NO: 1952 - RNA, 21 nt, Artificial Sequence
  Description of Artificial Sequence: Synthetic oligonucleotide
caagaucugacagugcacaau

SEQ ID NO: 1953 - RNA, 23 nt, Artificial Sequence
  Description of Artificial Sequence: Synthetic oligonucleotide
auugugcacugucagaucuugga

SEQ ID NO: 1954 - RNA, 21 nt, Artificial Sequence
  Description of Artificial Sequence: Synthetic oligonucleotide
acugauguucugaaagcucug

SEQ ID NO: 1955 - RNA, 23 nt, Artificial Sequence
  Description of Artificial Sequence: Synthetic oligonucleotide
cagagcuuucagaacaucagugc

SEQ ID NO: 1956 - RNA, 21 nt, Artificial Sequence
  Description of Artificial Sequence: Synthetic oligonucleotide
cugauguucugaaagcucugg

SEQ ID NO: 1957 - RNA, 23 nt, Artificial Sequence
  Description of Artificial Sequence: Synthetic oligonucleotide
ccagagcuuucagaacaucagug

SEQ ID NO: 1958 - RNA, 21 nt, Artificial Sequence
  Description of Artificial Sequence: Synthetic oligonucleotide
aggcacugauguucugaaagc

SEQ ID NO: 1959 - RNA, 23 nt, Artificial Sequence
  Description of Artificial Sequence: Synthetic oligonucleotide
gcuuucagaacaucagugccuuu

SEQ ID NO: 1960 - RNA, 21 nt, Artificial Sequence
  Description of Artificial Sequence: Synthetic oligonucleotide
aaggcacugauguucugaaag

SEQ ID NO: 1961 - RNA, 23 nt, Artificial Sequence
  Description of Artificial Sequence: Synthetic oligonucleotide
cuuucagaacaucagugccuuuc

SEQ ID NO: 1962 - RNA, 21 nt, Artificial Sequence
  Description of Artificial Sequence: Synthetic oligonucleotide
aacaacaugcuaaaucaguac

SEQ ID NO: 1963 - RNA, 23 nt, Artificial Sequence
  Description of Artificial Sequence: Synthetic oligonucleotide
guacugauuuagcauguuguuca

SEQ ID NO: 1964 - RNA, 21 nt, Artificial Sequence
  Description of Artificial Sequence: Synthetic oligonucleotide
acaacaugcuaaaucaguacu

SEQ ID NO: 1965 - RNA, 23 nt, Artificial Sequence
  Description of Artificial Sequence: Synthetic oligonucleotide
aguacugauuuagcauguuguuc

SEQ ID NO: 1966 - RNA, 21 nt, Artificial Sequence
  Description of Artificial Sequence: Synthetic oligonucleotide
uaugaacaacaugcuaaauca

SEQ ID NO: 1967 - RNA, 23 nt, Artificial Sequence
  Description of Artificial Sequence: Synthetic oligonucleotide
ugauuuagcauguuguucauaau

SEQ ID NO: 1968 - RNA, 21 nt, Artificial Sequence
  Description of Artificial Sequence: Synthetic oligonucleotide
uuaugaacaacaugcuaaauc

SEQ ID NO: 1969 - RNA, 23 nt, Artificial Sequence
  Description of Artificial Sequence: Synthetic oligonucleotide
gauuuagcauguuguucauaauc

SEQ ID NO: 1970 - RNA, 21 nt, Artificial Sequence
  Description of Artificial Sequence: Synthetic oligonucleotide
ucuuuagugucugaauauauc

SEQ ID NO: 1971 - RNA, 23 nt, Artificial Sequence
  Description of Artificial Sequence: Synthetic oligonucleotide
gauauauucagacacuaaagaug

SEQ ID NO: 1972 - RNA, 21 nt, Artificial Sequence
  Description of Artificial Sequence: Synthetic oligonucleotide
cuuuagugucugaauauaucc

SEQ ID NO: 1973 - RNA, 23 nt, Artificial Sequence
  Description of Artificial Sequence: Synthetic oligonucleotide
ggauauauucagacacuaaagau

SEQ ID NO: 1974 - RNA, 21 nt, Artificial Sequence
  Description of Artificial Sequence: Synthetic oligonucleotide
cacaucuuuagugucugaaua

SEQ ID NO: 1975 - RNA, 23 nt, Artificial Sequence
  Description of Artificial Sequence: Synthetic oligonucleotide
uauucagacacuaaagaugugau

SEQ ID NO: 1976 - RNA, 21 nt, Artificial Sequence
  Description of Artificial Sequence: Synthetic oligonucleotide
ucacaucuuuagugucugaau

SEQ ID NO: 1977 - RNA, 23 nt, Artificial Sequence
  Description of Artificial Sequence: Synthetic oligonucleotide
auucagacacuaaagaugugauu

SEQ ID NO: 1978 - RNA, 21 nt, Artificial Sequence
  Description of Artificial Sequence: Synthetic oligonucleotide
ugauacuucuuugaauguaga

SEQ ID NO: 1979 - RNA, 23 nt, Artificial Sequence
  Description of Artificial Sequence: Synthetic oligonucleotide
ucuacauucaaagaaguaucacc

SEQ ID NO: 1980 - RNA, 21 nt, Artificial Sequence
  Description of Artificial Sequence: Synthetic oligonucleotide
gauacuucuuugaauguagau

SEQ ID NO: 1981 - RNA, 23 nt, Artificial Sequence
  Description of Artificial Sequence: Synthetic oligonucleotide
aucuacauucaaagaaguaucac

SEQ ID NO: 1982 - RNA, 21 nt, Artificial Sequence
  Description of Artificial Sequence: Synthetic oligonucleotide
uuggugauacuucuuugaaug

SEQ ID NO: 1983 - RNA, 23 nt, Artificial Sequence
  Description of Artificial Sequence: Synthetic oligonucleotide
cauucaaagaaguaucaccaauu

SEQ ID NO: 1984 - RNA, 21 nt, Artificial Sequence
  Description of Artificial Sequence: Synthetic oligonucleotide
auuggugauacuucuuugaau

SEQ ID NO: 1985 - RNA, 23 nt, Artificial Sequence
  Description of Artificial Sequence: Synthetic oligonucleotide
auucaaagaaguaucaccaauua

SEQ ID NO: 1986 - RNA, 21 nt, Artificial Sequence
  Description of Artificial Sequence: Synthetic oligonucleotide
aauaaccugugaaaaugcucc

SEQ ID NO: 1987 - RNA, 23 nt, Artificial Sequence
  Description of Artificial Sequence: Synthetic oligonucleotide
ggagcauuuucacagguuauugc

SEQ ID NO: 1988 - RNA, 21 nt, Artificial Sequence
  Description of Artificial Sequence: Synthetic oligonucleotide
auaaccugugaaaaugcuccc

SEQ ID NO: 1989 - RNA, 23 nt, Artificial Sequence
  Description of Artificial Sequence: Synthetic oligonucleotide
gggagcauuuucacagguuauug

SEQ ID NO: 1990 - RNA, 21 nt, Artificial Sequence
  Description of Artificial Sequence: Synthetic oligonucleotide
uagcaauaaccugugaaaaug

SEQ ID NO: 1991 - RNA, 23 nt, Artificial Sequence
  Description of Artificial Sequence: Synthetic oligonucleotide
cauuuucacagguuauugcuauc

SEQ ID NO: 1992 - RNA, 21 nt, Artificial Sequence
  Description of Artificial Sequence: Synthetic oligonucleotide
auagcaauaaccugugaaaau

SEQ ID NO: 1993 - RNA, 23 nt, Artificial Sequence
  Description of Artificial Sequence: Synthetic oligonucleotide
auuuucacagguuauugcuaucc

SEQ ID NO: 1994 - RNA, 21 nt, Artificial Sequence
  Description of Artificial Sequence: Synthetic oligonucleotide
aaucacaucuuuagugucuga

SEQ ID NO: 1995 - RNA, 23 nt, Artificial Sequence
  Description of Artificial Sequence: Synthetic oligonucleotide
ucagacacuaaagaugugauugg

SEQ ID NO: 1996 - RNA, 21 nt, Artificial Sequence
  Description of Artificial Sequence: Synthetic oligonucleotide
aucacaucuuuagugucugaa

SEQ ID NO: 1997 - RNA, 23 nt, Artificial Sequence
  Description of Artificial Sequence: Synthetic oligonucleotide
uucagacacuaaagaugugauug

SEQ ID NO: 1998 - RNA, 21 nt, Artificial Sequence
  Description of Artificial Sequence: Synthetic oligonucleotide
uuccaaucacaucuuuagugu

SEQ ID NO: 1999 - RNA, 23 nt, Artificial Sequence
  Description of Artificial Sequence: Synthetic oligonucleotide
acacuaaagaugugauuggaaau

SEQ ID NO: 2000 - RNA, 21 nt, Artificial Sequence
  Description of Artificial Sequence: Synthetic oligonucleotide
uuuccaaucacaucuuuagug

SEQ ID NO: 2001 - RNA, 23 nt, Artificial Sequence
  Description of Artificial Sequence: Synthetic oligonucleotide
cacuaaagaugugauuggaaauc

SEQ ID NO: 2002 - RNA, 21 nt, Artificial Sequence
  Description of Artificial Sequence: Synthetic oligonucleotide
acgggcaugauguugaguucc

SEQ ID NO: 2003 - RNA, 23 nt, Artificial Sequence
  Description of Artificial Sequence: Synthetic oligonucleotide
ggaacucaacaucaugcccguuc

SEQ ID NO: 2004 - RNA, 21 nt, Artificial Sequence
  Description of Artificial Sequence: Synthetic oligonucleotide
cgggcaugauguugaguuccu

SEQ ID NO: 2005 - RNA, 23 nt, Artificial Sequence
  Description of Artificial Sequence: Synthetic oligonucleotide
aggaacucaacaucaugcccguu

SEQ ID NO: 2006 - RNA, 21 nt, Artificial Sequence
  Description of Artificial Sequence: Synthetic oligonucleotide
gggaacgggcaugauguugag

SEQ ID NO: 2007 - RNA, 23 nt, Artificial Sequence
  Description of Artificial Sequence: Synthetic oligonucleotide
cucaacaucaugcccguucccag

SEQ ID NO: 2008 - RNA, 21 nt, Artificial Sequence
  Description of Artificial Sequence: Synthetic oligonucleotide
ugggaacgggcaugauguuga

SEQ ID NO: 2009 - RNA, 23 nt, Artificial Sequence
  Description of Artificial Sequence: Synthetic oligonucleotide
ucaacaucaugcccguucccagg

SEQ ID NO: 2010 - RNA, 21 nt, Artificial Sequence
  Description of Artificial Sequence: Synthetic oligonucleotide
acuaaggugaaaagauaauga

SEQ ID NO: 2011 - RNA, 23 nt, Artificial Sequence
  Description of Artificial Sequence: Synthetic oligonucleotide
ucauuaucuuuucaccuuagugu

SEQ ID NO: 2012 - RNA, 21 nt, Artificial Sequence
  Description of Artificial Sequence: Synthetic oligonucleotide
cuaaggugaaaagauaaugau

SEQ ID NO: 2013 - RNA, 23 nt, Artificial Sequence
  Description of Artificial Sequence: Synthetic oligonucleotide
aucauuaucuuuucaccuuagug

SEQ ID NO: 2014 - RNA, 21 nt, Artificial Sequence
  Description of Artificial Sequence: Synthetic oligonucleotide
aaacacuaaggugaaaagaua

SEQ ID NO: 2015 - RNA, 23 nt, Artificial Sequence
  Description of Artificial Sequence: Synthetic oligonucleotide
uaucuuuucaccuuaguguuugc

SEQ ID NO: 2016 - RNA, 21 nt, Artificial Sequence
  Description of Artificial Sequence: Synthetic oligonucleotide
caaacacuaaggugaaaagau

SEQ ID NO: 2017 - RNA, 23 nt, Artificial Sequence
  Description of Artificial Sequence: Synthetic oligonucleotide
aucuuuucaccuuaguguuugcu

SEQ ID NO: 2018 - RNA, 21 nt, Artificial Sequence
  Description of Artificial Sequence: Synthetic oligonucleotide
agguagcacuggagagaauug

SEQ ID NO: 2019 - RNA, 23 nt, Artificial Sequence
  Description of Artificial Sequence: Synthetic oligonucleotide
caauucucuccagugcuaccuuc

SEQ ID NO: 2020 - RNA, 21 nt, Artificial Sequence
  Description of Artificial Sequence: Synthetic oligonucleotide
gguagcacuggagagaauugg

SEQ ID NO: 2021 - RNA, 23 nt, Artificial Sequence
  Description of Artificial Sequence: Synthetic oligonucleotide
ccaauucucuccagugcuaccuu

SEQ ID NO: 2022 - RNA, 21 nt, Artificial Sequence
  Description of Artificial Sequence: Synthetic oligonucleotide
gagaagguagcacuggagaga

SEQ ID NO: 2023 - RNA, 23 nt, Artificial Sequence
  Description of Artificial Sequence: Synthetic oligonucleotide
ucucuccagugcuaccuucucaa

SEQ ID NO: 2024 - RNA, 21 nt, Artificial Sequence
  Description of Artificial Sequence: Synthetic oligonucleotide
ugagaagguagcacuggagag

SEQ ID NO: 2025 - RNA, 23 nt, Artificial Sequence
  Description of Artificial Sequence: Synthetic oligonucleotide
cucuccagugcuaccuucucaaa

SEQ ID NO: 2026 - RNA, 21 nt, Artificial Sequence
  Description of Artificial Sequence: Synthetic oligonucleotide
aguggacuugcugcauaugug

SEQ ID NO: 2027 - RNA, 23 nt, Artificial Sequence
  Description of Artificial Sequence: Synthetic oligonucleotide
cacauaugcagcaaguccacugu

SEQ ID NO: 2028 - RNA, 21 nt, Artificial Sequence
  Description of Artificial Sequence: Synthetic oligonucleotide
guggacuugcugcauaugugg

SEQ ID NO: 2029 - RNA, 23 nt, Artificial Sequence
  Description of Artificial Sequence: Synthetic oligonucleotide
ccacauaugcagcaaguccacug

SEQ ID NO: 2030 - RNA, 21 nt, Artificial Sequence
  Description of Artificial Sequence: Synthetic oligonucleotide
cgacaguggacuugcugcaua

SEQ ID NO: 2031 - RNA, 23 nt, Artificial Sequence
  Description of Artificial Sequence: Synthetic oligonucleotide
uaugcagcaaguccacugucguc

SEQ ID NO: 2032 - RNA, 21 nt, Artificial Sequence
  Description of Artificial Sequence: Synthetic oligonucleotide
acgacaguggacuugcugcau

SEQ ID NO: 2033 - RNA, 23 nt, Artificial Sequence
  Description of Artificial Sequence: Synthetic oligonucleotide
augcagcaaguccacugucgucu

SEQ ID NO: 2034 - RNA, 21 nt, Artificial Sequence
  Description of Artificial Sequence: Synthetic oligonucleotide
aagguguucaagauguccucg

SEQ ID NO: 2035 - RNA, 23 nt, Artificial Sequence
  Description of Artificial Sequence: Synthetic oligonucleotide
cgaggacaucuugaacaccuuuc

SEQ ID NO: 2036 - RNA, 21 nt, Artificial Sequence
  Description of Artificial Sequence: Synthetic oligonucleotide
agguguucaagauguccucga

SEQ ID NO: 2037 - RNA, 23 nt, Artificial Sequence
  Description of Artificial Sequence: Synthetic oligonucleotide
ucgaggacaucuugaacaccuuu

SEQ ID NO: 2038 - RNA, 21 nt, Artificial Sequence
  Description of Artificial Sequence: Synthetic oligonucleotide
gagaaagguguucaagauguc

SEQ ID NO: 2039 - RNA, 23 nt, Artificial Sequence
  Description of Artificial Sequence: Synthetic oligonucleotide
gacaucuugaacaccuuucuccc

SEQ ID NO: 2040 - RNA, 21 nt, Artificial Sequence
  Description of Artificial Sequence: Synthetic oligonucleotide
ggagaaagguguucaagaugu

SEQ ID NO: 2041 - RNA, 23 nt, Artificial Sequence
  Description of Artificial Sequence: Synthetic oligonucleotide
acaucuugaacaccuuucucccc

SEQ ID NO: 2042 - RNA, 21 nt, Artificial Sequence
  Description of Artificial Sequence: Synthetic oligonucleotide
aaccgucuggaugaugugcgu

SEQ ID NO: 2043 - RNA, 23 nt, Artificial Sequence
  Description of Artificial Sequence: Synthetic oligonucleotide
acgcacaucauccagacgguugc

SEQ ID NO: 2044 - RNA, 21 nt, Artificial Sequence
  Description of Artificial Sequence: Synthetic oligonucleotide
accgucuggaugaugugcgua

SEQ ID NO: 2045 - RNA, 23 nt, Artificial Sequence
  Description of Artificial Sequence: Synthetic oligonucleotide
uacgcacaucauccagacgguug

SEQ ID NO: 2046 - RNA, 21 nt, Artificial Sequence
  Description of Artificial Sequence: Synthetic oligonucleotide
gggcaaccgucuggaugaugu

SEQ ID NO: 2047 - RNA, 23 nt, Artificial Sequence
  Description of Artificial Sequence: Synthetic oligonucleotide
acaucauccagacgguugcccag

SEQ ID NO: 2048 - RNA, 21 nt, Artificial Sequence
  Description of Artificial Sequence: Synthetic oligonucleotide
ugggcaaccgucuggaugaug

SEQ ID NO: 2049 - RNA, 23 nt, Artificial Sequence
  Description of Artificial Sequence: Synthetic oligonucleotide
caucauccagacgguugcccagg

SEQ ID NO: 2050 - RNA, 21 nt, Artificial Sequence
  Description of Artificial Sequence: Synthetic oligonucleotide
gaaacuuuggcugauaauauu

SEQ ID NO: 2051 - RNA, 23 nt, Artificial Sequence
  Description of Artificial Sequence: Synthetic oligonucleotide
aauauuaucagccaaaguuucuu

SEQ ID NO: 2052 - RNA, 21 nt, Artificial Sequence
  Description of Artificial Sequence: Synthetic oligonucleotide
aaacuuuggcugauaauauug

SEQ ID NO: 2053 - RNA, 23 nt, Artificial Sequence
  Description of Artificial Sequence: Synthetic oligonucleotide
caauauuaucagccaaaguuucu

SEQ ID NO: 2054 - RNA, 21 nt, Artificial Sequence
  Description of Artificial Sequence: Synthetic oligonucleotide
ugaagaaacuuuggcugauaa

SEQ ID NO: 2055 - RNA, 23 nt, Artificial Sequence
  Description of Artificial Sequence: Synthetic oligonucleotide
uuaucagccaaaguuucuucauc

SEQ ID NO: 2056 - RNA, 21 nt, Artificial Sequence
  Description of Artificial Sequence: Synthetic oligonucleotide
augaagaaacuuuggcugaua

SEQ ID NO: 2057 - RNA, 23 nt, Artificial Sequence
  Description of Artificial Sequence: Synthetic oligonucleotide
uaucagccaaaguuucuucauca

SEQ ID NO: 2058 - RNA, 21 nt, Artificial Sequence
  Description of Artificial Sequence: Synthetic oligonucleotide
aaagguguucaagauguccuc

SEQ ID NO: 2059 - RNA, 23 nt, Artificial Sequence
  Description of Artificial Sequence: Synthetic oligonucleotide
gaggacaucuugaacaccuuucu

SEQ ID NO: 2060 - RNA, 21 nt, Artificial Sequence
  Description of Artificial Sequence: Synthetic oligonucleotide
aagguguucaagauguccucg

SEQ ID NO: 2061 - RNA, 23 nt, Artificial Sequence
  Description of Artificial Sequence: Synthetic oligonucleotide
cgaggacaucuugaacaccuuuc

SEQ ID NO: 2062 - RNA, 21 nt, Artificial Sequence
  Description of Artificial Sequence: Synthetic oligonucleotide
ggagaaagguguucaagaugu

SEQ ID NO: 2063 - RNA, 23 nt, Artificial Sequence
  Description of Artificial Sequence: Synthetic oligonucleotide
acaucuugaacaccuuucucccc

SEQ ID NO: 2064 - RNA, 21 nt, Artificial Sequence
  Description of Artificial Sequence: Synthetic oligonucleotide
gggagaaagguguucaagaug

SEQ ID NO: 2065 - RNA, 23 nt, Artificial Sequence
  Description of Artificial Sequence: Synthetic oligonucleotide
caucuugaacaccuuucuccccc

SEQ ID NO: 2066 - RNA, 21 nt, Artificial Sequence
  Description of Artificial Sequence: Synthetic oligonucleotide
aaaucaguacuuccaaagucu

SEQ ID NO: 2067 - RNA, 23 nt, Artificial Sequence
  Description of Artificial Sequence: Synthetic oligonucleotide
agacuuuggaaguacugauuuag

SEQ ID NO: 2068 - RNA, 21 nt, Artificial Sequence
  Description of Artificial Sequence: Synthetic oligonucleotide
aaucaguacuuccaaagucua

SEQ ID NO: 2069 - RNA, 23 nt, Artificial Sequence
  Description of Artificial Sequence: Synthetic oligonucleotide
uagacuuuggaaguacugauuua

SEQ ID NO: 2070 - RNA, 21 nt, Artificial Sequence
  Description of Artificial Sequence: Synthetic oligonucleotide
ugcuaaaucaguacuuccaaa

SEQ ID NO: 2071 - RNA, 23 nt, Artificial Sequence
  Description of Artificial Sequence: Synthetic oligonucleotide
uuuggaaguacugauuuagcaug

SEQ ID NO: 2072 - RNA, 21 nt, Artificial Sequence
  Description of Artificial Sequence: Synthetic oligonucleotide
augcuaaaucaguacuuccaa

SEQ ID NO: 2073 - RNA, 23 nt, Artificial Sequence
  Description of Artificial Sequence: Synthetic oligonucleotide
uuggaaguacugauuuagcaugu

SEQ ID NO: 2074 - RNA, 21 nt, Artificial Sequence
  Description of Artificial Sequence: Synthetic oligonucleotide
acaucuuuagugucugaauau

SEQ ID NO: 2075 - RNA, 23 nt, Artificial Sequence
  Description of Artificial Sequence: Synthetic oligonucleotide
auauucagacacuaaagauguga

SEQ ID NO: 2076 - RNA, 21 nt, Artificial Sequence
  Description of Artificial Sequence: Synthetic oligonucleotide
caucuuuagugucugaauaua

SEQ ID NO: 2077 - RNA, 23 nt, Artificial Sequence
  Description of Artificial Sequence: Synthetic oligonucleotide
uauauucagacacuaaagaugug

SEQ ID NO: 2078 - RNA, 21 nt, Artificial Sequence
  Description of Artificial Sequence: Synthetic oligonucleotide
aaucacaucuuuagugucuga

SEQ ID NO: 2079 - RNA, 23 nt, Artificial Sequence
  Description of Artificial Sequence: Synthetic oligonucleotide
ucagacacuaaagaugugauugg

SEQ ID NO: 2080 - RNA, 21 nt, Artificial Sequence
  Description of Artificial Sequence: Synthetic oligonucleotide
caaucacaucuuuagugucug

SEQ ID NO: 2081 - RNA, 23 nt, Artificial Sequence
  Description of Artificial Sequence: Synthetic oligonucleotide
cagacacuaaagaugugauugga

SEQ ID NO: 2082 - RNA, 21 nt, Artificial Sequence
  Description of Artificial Sequence: Synthetic oligonucleotide
gcauguauuacuugacaaaga

SEQ ID NO: 2083 - RNA, 23 nt, Artificial Sequence
  Description of Artificial Sequence: Synthetic oligonucleotide
ucuuugucaaguaauacaugcug

SEQ ID NO: 2084 - RNA, 21 nt, Artificial Sequence
  Description of Artificial Sequence: Synthetic oligonucleotide
cauguauuacuugacaaagag

SEQ ID NO: 2085 - RNA, 23 nt, Artificial Sequence
  Description of Artificial Sequence: Synthetic oligonucleotide
cucuuugucaaguaauacaugcu

SEQ ID NO: 2086 - RNA, 21 nt, Artificial Sequence
  Description of Artificial Sequence: Synthetic oligonucleotide
uucagcauguauuacuugaca

SEQ ID NO: 2087 - RNA, 23 nt, Artificial Sequence
  Description of Artificial Sequence: Synthetic oligonucleotide
ugucaaguaauacaugcugaaaa

SEQ ID NO: 2088 - RNA, 21 nt, Artificial Sequence
  Description of Artificial Sequence: Synthetic oligonucleotide
uuucagcauguauuacuugac

SEQ ID NO: 2089 - RNA, 23 nt, Artificial Sequence
  Description of Artificial Sequence: Synthetic oligonucleotide
gucaaguaauacaugcugaaaaa

SEQ ID NO: 2090 - RNA, 21 nt, Artificial Sequence
  Description of Artificial Sequence: Synthetic oligonucleotide
auguuacuucuuagagagaaa

SEQ ID NO: 2091 - RNA, 23 nt, Artificial Sequence
  Description of Artificial Sequence: Synthetic oligonucleotide
uuucucucuaagaaguaacauac

SEQ ID NO: 2092 - RNA, 21 nt, Artificial Sequence
  Description of Artificial Sequence: Synthetic oligonucleotide
uguuacuucuuagagagaaau

SEQ ID NO: 2093 - RNA, 23 nt, Artificial Sequence
  Description of Artificial Sequence: Synthetic oligonucleotide
auuucucucuaagaaguaacaua

SEQ ID NO: 2094 - RNA, 21 nt, Artificial Sequence
  Description of Artificial Sequence: Synthetic oligonucleotide
auguauguuacuucuuagaga

SEQ ID NO: 2095 - RNA, 23 nt, Artificial Sequence
  Description of Artificial Sequence: Synthetic oligonucleotide
ucucuaagaaguaacauacaucc

SEQ ID NO: 2096 - RNA, 21 nt, Artificial Sequence
  Description of Artificial Sequence: Synthetic oligonucleotide
gauguauguuacuucuuagag

SEQ ID NO: 2097 - RNA, 23 nt, Artificial Sequence
  Description of Artificial Sequence: Synthetic oligonucleotide
cucuaagaaguaacauacauccu

SEQ ID NO: 2098 - RNA, 21 nt, Artificial Sequence
  Description of Artificial Sequence: Synthetic oligonucleotide
acaacuuugagaagguagcac

SEQ ID NO: 2099 - RNA, 23 nt, Artificial Sequence
  Description of Artificial Sequence: Synthetic oligonucleotide
gugcuaccuucucaaaguuguga

SEQ ID NO: 2100 - RNA, 21 nt, Artificial Sequence
  Description of Artificial Sequence: Synthetic oligonucleotide
caacuuugagaagguagcacu

SEQ ID NO: 2101 - RNA, 23 nt, Artificial Sequence
  Description of Artificial Sequence: Synthetic oligonucleotide
agugcuaccuucucaaaguugug

SEQ ID NO: 2102 - RNA, 21 nt, Artificial Sequence
  Description of Artificial Sequence: Synthetic oligonucleotide
auucacaacuuugagaaggua

SEQ ID NO: 2103 - RNA, 23 nt, Artificial Sequence
  Description of Artificial Sequence: Synthetic oligonucleotide
uaccuucucaaaguugugaauca

SEQ ID NO: 2104 - RNA, 21 nt, Artificial Sequence
  Description of Artificial Sequence: Synthetic oligonucleotide
gauucacaacuuugagaaggu

SEQ ID NO: 2105 - RNA, 23 nt, Artificial Sequence
  Description of Artificial Sequence: Synthetic oligonucleotide
accuucucaaaguugugaaucag

SEQ ID NO: 2106 - RNA, 21 nt, Artificial Sequence
  Description of Artificial Sequence: Synthetic oligonucleotide
aacaugcuaaaucaguacuuc

SEQ ID NO: 2107 - RNA, 23 nt, Artificial Sequence
  Description of Artificial Sequence: Synthetic oligonucleotide
gaaguacugauuuagcauguugu

SEQ ID NO: 2108 - RNA, 21 nt, Artificial Sequence
  Description of Artificial Sequence: Synthetic oligonucleotide
acaugcuaaaucaguacuucc

SEQ ID NO: 2109 - RNA, 23 nt, Artificial Sequence
  Description of Artificial Sequence: Synthetic oligonucleotide
ggaaguacugauuuagcauguug

SEQ ID NO: 2110 - RNA, 21 nt, Artificial Sequence
  Description of Artificial Sequence: Synthetic oligonucleotide
gaacaacaugcuaaaucagua

SEQ ID NO: 2111 - RNA, 23 nt, Artificial Sequence
  Description of Artificial Sequence: Synthetic oligonucleotide
uacugauuuagcauguuguucau

SEQ ID NO: 2112 - RNA, 21 nt, Artificial Sequence
  Description of Artificial Sequence: Synthetic oligonucleotide
ugaacaacaugcuaaaucagu

SEQ ID NO: 2113 - RNA, 23 nt, Artificial Sequence
  Description of Artificial Sequence: Synthetic oligonucleotide
acugauuuagcauguuguucaua

SEQ ID NO: 2114 - RNA, 21 nt, Artificial Sequence
  Description of Artificial Sequence: Synthetic oligonucleotide
aaaccaguacuuuaucauuuu

SEQ ID NO: 2115 - RNA, 23 nt, Artificial Sequence
  Description of Artificial Sequence: Synthetic oligonucleotide
aaaaugauaaaguacugguuuca

SEQ ID NO: 2116 - RNA, 21 nt, Artificial Sequence
  Description of Artificial Sequence: Synthetic oligonucleotide
aaccaguacuuuaucauuuuc

SEQ ID NO: 2117 - RNA, 23 nt, Artificial Sequence
  Description of Artificial Sequence: Synthetic oligonucleotide
gaaaaugauaaaguacugguuuc

SEQ ID NO: 2118 - RNA, 21 nt, Artificial Sequence
  Description of Artificial Sequence: Synthetic oligonucleotide
uuugaaaccaguacuuuauca

SEQ ID NO: 2119 - RNA, 23 nt, Artificial Sequence
  Description of Artificial Sequence: Synthetic oligonucleotide
ugauaaaguacugguuucaaaau

SEQ ID NO: 2120 - RNA, 21 nt, Artificial Sequence
  Description of Artificial Sequence: Synthetic oligonucleotide
uuuugaaaccaguacuuuauc

SEQ ID NO: 2121 - RNA, 23 nt, Artificial Sequence
  Description of Artificial Sequence: Synthetic oligonucleotide
gauaaaguacugguuucaaaauu

SEQ ID NO: 2122 - RNA, 21 nt, Artificial Sequence
  Description of Artificial Sequence: Synthetic oligonucleotide
gagaagaugggcuacaaggcc

SEQ ID NO: 2123 - RNA, 23 nt, Artificial Sequence
  Description of Artificial Sequence: Synthetic oligonucleotide
ggccuuguagcccaucuucucug

SEQ ID NO: 2124 - RNA, 21 nt, Artificial Sequence
  Description of Artificial Sequence: Synthetic oligonucleotide
agaagaugggcuacaaggcca

SEQ ID NO: 2125 - RNA, 23 nt, Artificial Sequence
  Description of Artificial Sequence: Synthetic oligonucleotide
uggccuuguagcccaucuucucu

SEQ ID NO: 2126 - RNA, 21 nt, Artificial Sequence
  Description of Artificial Sequence: Synthetic oligonucleotide
ggcagagaagaugggcuacaa

SEQ ID NO: 2127 - RNA, 23 nt, Artificial Sequence
  Description of Artificial Sequence: Synthetic oligonucleotide
uuguagcccaucuucucugccug

SEQ ID NO: 2128 - RNA, 21 nt, Artificial Sequence
  Description of Artificial Sequence: Synthetic oligonucleotide
aggcagagaagaugggcuaca

SEQ ID NO: 2129 - RNA, 23 nt, Artificial Sequence
  Description of Artificial Sequence: Synthetic oligonucleotide
uguagcccaucuucucugccugc

SEQ ID NO: 2130 - RNA, 21 nt, Artificial Sequence
  Description of Artificial Sequence: Synthetic oligonucleotide
aacgggcaugauguugaguuc

SEQ ID NO: 2131 - RNA, 23 nt, Artificial Sequence
  Description of Artificial Sequence: Synthetic oligonucleotide
gaacucaacaucaugcccguucc

SEQ ID NO: 2132 - RNA, 21 nt, Artificial Sequence
  Description of Artificial Sequence: Synthetic oligonucleotide
acgggcaugauguugaguucc

SEQ ID NO: 2133 - RNA, 23 nt, Artificial Sequence
  Description of Artificial Sequence: Synthetic oligonucleotide
ggaacucaacaucaugcccguuc

SEQ ID NO: 2134 - RNA, 21 nt, Artificial Sequence
  Description of Artificial Sequence: Synthetic oligonucleotide
ugggaacgggcaugauguuga

SEQ ID NO: 2135 - RNA, 23 nt, Artificial Sequence
  Description of Artificial Sequence: Synthetic oligonucleotide
ucaacaucaugcccguucccagg

SEQ ID NO: 2136 - RNA, 21 nt, Artificial Sequence
  Description of Artificial Sequence: Synthetic oligonucleotide
cugggaacgggcaugauguug

SEQ ID NO: 2137 - RNA, 23 nt, Artificial Sequence
  Description of Artificial Sequence: Synthetic oligonucleotide
caacaucaugcccguucccaggg

SEQ ID NO: 2138 - RNA, 21 nt, Artificial Sequence
  Description of Artificial Sequence: Synthetic oligonucleotide
auguggcuaaagcaauagacc

SEQ ID NO: 2139 - RNA, 23 nt, Artificial Sequence
  Description of Artificial Sequence: Synthetic oligonucleotide
ggucuauugcuuuagccacauau

SEQ ID NO: 2140 - RNA, 21 nt, Artificial Sequence
  Description of Artificial Sequence: Synthetic oligonucleotide
uguggcuaaagcaauagaccc

SEQ ID NO: 2141 - RNA, 23 nt, Artificial Sequence
  Description of Artificial Sequence: Synthetic oligonucleotide
gggucuauugcuuuagccacaua

SEQ ID NO: 2142 - RNA, 21 nt, Artificial Sequence
  Description of Artificial Sequence: Synthetic oligonucleotide
gcauauguggcuaaagcaaua

SEQ ID NO: 2143 - RNA, 23 nt, Artificial Sequence
  Description of Artificial Sequence: Synthetic oligonucleotide
uauugcuuuagccacauaugcag

SEQ ID NO: 2144 - RNA, 21 nt, Artificial Sequence
  Description of Artificial Sequence: Synthetic oligonucleotide
ugcauauguggcuaaagcaau

SEQ ID NO: 2145 - RNA, 23 nt, Artificial Sequence
  Description of Artificial Sequence: Synthetic oligonucleotide
auugcuuuagccacauaugcagc

SEQ ID NO: 2146 - RNA, 21 nt, Artificial Sequence
  Description of Artificial Sequence: Synthetic oligonucleotide
aggaugcuccggaauguugcu

SEQ ID NO: 2147 - RNA, 23 nt, Artificial Sequence
  Description of Artificial Sequence: Synthetic oligonucleotide
agcaacauuccggagcauccuug

SEQ ID NO: 2148 - RNA, 21 nt, Artificial Sequence
  Description of Artificial Sequence: Synthetic oligonucleotide
ggaugcuccggaauguugcug

SEQ ID NO: 2149 - RNA, 23 nt, Artificial Sequence
  Description of Artificial Sequence: Synthetic oligonucleotide
cagcaacauuccggagcauccuu

SEQ ID NO: 2150 - RNA, 21 nt, Artificial Sequence
  Description of Artificial Sequence: Synthetic oligonucleotide
uccaaggaugcuccggaaugu

SEQ ID NO: 2151 - RNA, 23 nt, Artificial Sequence
  Description of Artificial Sequence: Synthetic oligonucleotide
acauuccggagcauccuuggaua

SEQ ID NO: 2152 - RNA, 21 nt, Artificial Sequence
  Description of Artificial Sequence: Synthetic oligonucleotide
auccaaggaugcuccggaaug

SEQ ID NO: 2153 - RNA, 23 nt, Artificial Sequence
  Description of Artificial Sequence: Synthetic oligonucleotide
cauuccggagcauccuuggauac

SEQ ID NO: 2154 - RNA, 21 nt, Artificial Sequence
  Description of Artificial Sequence: Synthetic oligonucleotide
ucacaucuuuagugucugaau

SEQ ID NO: 2155 - RNA, 23 nt, Artificial Sequence
  Description of Artificial Sequence: Synthetic oligonucleotide
auucagacacuaaagaugugauu

SEQ ID NO: 2156 - RNA, 21 nt, Artificial Sequence
  Description of Artificial Sequence: Synthetic oligonucleotide
cacaucuuuagugucugaaua

SEQ ID NO: 2157 - RNA, 23 nt, Artificial Sequence
  Description of Artificial Sequence: Synthetic oligonucleotide
uauucagacacuaaagaugugau

SEQ ID NO: 2158 - RNA, 21 nt, Artificial Sequence
  Description of Artificial Sequence: Synthetic oligonucleotide
ccaaucacaucuuuagugucu

SEQ ID NO: 2159 - RNA, 23 nt, Artificial Sequence
  Description of Artificial Sequence: Synthetic oligonucleotide
agacacuaaagaugugauuggaa

SEQ ID NO: 2160 - RNA, 21 nt, Artificial Sequence
  Description of Artificial Sequence: Synthetic oligonucleotide
uccaaucacaucuuuaguguc

SEQ ID NO: 2161 - RNA, 23 nt, Artificial Sequence
  Description of Artificial Sequence: Synthetic oligonucleotide
gacacuaaagaugugauuggaaa

SEQ ID NO: 2162 - RNA, 21 nt, Artificial Sequence
  Description of Artificial Sequence: Synthetic oligonucleotide
aaauguguuuagacaacguca

SEQ ID NO: 2163 - RNA, 23 nt, Artificial Sequence
  Description of Artificial Sequence: Synthetic oligonucleotide
ugacguugucuaaacacauuuuc

SEQ ID NO: 2164 - RNA, 21 nt, Artificial Sequence
  Description of Artificial Sequence: Synthetic oligonucleotide
aauguguuuagacaacgucau

SEQ ID NO: 2165 - RNA, 23 nt, Artificial Sequence
  Description of Artificial Sequence: Synthetic oligonucleotide
augacguugucuaaacacauuuu

SEQ ID NO: 2166 - RNA, 21 nt, Artificial Sequence
  Description of Artificial Sequence: Synthetic oligonucleotide
uugaaaauguguuuagacaac

SEQ ID NO: 2167 - RNA, 23 nt, Artificial Sequence
  Description of Artificial Sequence: Synthetic oligonucleotide
guugucuaaacacauuuucaaug

SEQ ID NO: 2168 - RNA, 21 nt, Artificial Sequence
  Description of Artificial Sequence: Synthetic oligonucleotide
auugaaaauguguuuagacaa

SEQ ID NO: 2169 - RNA, 23 nt, Artificial Sequence
  Description of Artificial Sequence: Synthetic oligonucleotide
uugucuaaacacauuuucaaugu

SEQ ID NO: 2170 - RNA, 21 nt, Artificial Sequence
  Description of Artificial Sequence: Synthetic oligonucleotide
uacuaaaggaagaauuccggu

SEQ ID NO: 2171 - RNA, 23 nt, Artificial Sequence
  Description of Artificial Sequence: Synthetic oligonucleotide
accggaauucuuccuuuaguauc

SEQ ID NO: 2172 - RNA, 21 nt, Artificial Sequence
  Description of Artificial Sequence: Synthetic oligonucleotide
acuaaaggaagaauuccgguu

SEQ ID NO: 2173 - RNA, 23 nt, Artificial Sequence
  Description of Artificial Sequence: Synthetic oligonucleotide
aaccggaauucuuccuuuaguau

SEQ ID NO: 2174 - RNA, 21 nt, Artificial Sequence
  Description of Artificial Sequence: Synthetic oligonucleotide
gagauacuaaaggaagaauuc

SEQ ID NO: 2175 - RNA, 23 nt, Artificial Sequence
  Description of Artificial Sequence: Synthetic oligonucleotide
gaauucuuccuuuaguaucucga

SEQ ID NO: 2176 - RNA, 21 nt, Artificial Sequence
  Description of Artificial Sequence: Synthetic oligonucleotide
cgagauacuaaaggaagaauu

SEQ ID NO: 2177 - RNA, 23 nt, Artificial Sequence
  Description of Artificial Sequence: Synthetic oligonucleotide
aauucuuccuuuaguaucucgag

SEQ ID NO: 2178 - RNA, 21 nt, Artificial Sequence
  Description of Artificial Sequence: Synthetic oligonucleotide
aacuuuggcugauaauauugc

SEQ ID NO: 2179 - RNA, 23 nt, Artificial Sequence
  Description of Artificial Sequence: Synthetic oligonucleotide
gcaauauuaucagccaaaguuuc

SEQ ID NO: 2180 - RNA, 21 nt, Artificial Sequence
  Description of Artificial Sequence: Synthetic oligonucleotide
acuuuggcugauaauauugca

SEQ ID NO: 2181 - RNA, 23 nt, Artificial Sequence
  Description of Artificial Sequence: Synthetic oligonucleotide
ugcaauauuaucagccaaaguuu

SEQ ID NO: 2182 - RNA, 21 nt, Artificial Sequence
  Description of Artificial Sequence: Synthetic oligonucleotide
aagaaacuuuggcugauaaua

SEQ ID NO: 2183 - RNA, 23 nt, Artificial Sequence
  Description of Artificial Sequence: Synthetic oligonucleotide
uauuaucagccaaaguuucuuca

SEQ ID NO: 2184 - RNA, 21 nt, Artificial Sequence
  Description of Artificial Sequence: Synthetic oligonucleotide
gaagaaacuuuggcugauaau

SEQ ID NO: 2185 - RNA, 23 nt, Artificial Sequence
  Description of Artificial Sequence: Synthetic oligonucleotide
auuaucagccaaaguuucuucau

SEQ ID NO: 2186 - RNA, 21 nt, Artificial Sequence
  Description of Artificial Sequence: Synthetic oligonucleotide
aaauggcugagaagacugaca

SEQ ID NO: 2187 - RNA, 23 nt, Artificial Sequence
  Description of Artificial Sequence: Synthetic oligonucleotide
ugucagucuucucagccauuuga

SEQ ID NO: 2188 - RNA, 21 nt, Artificial Sequence
  Description of Artificial Sequence: Synthetic oligonucleotide
aauggcugagaagacugacau

SEQ ID NO: 2189 - RNA, 23 nt, Artificial Sequence
  Description of Artificial Sequence: Synthetic oligonucleotide
augucagucuucucagccauuug

SEQ ID NO: 2190 - RNA, 21 nt, Artificial Sequence
  Description of Artificial Sequence: Synthetic oligonucleotide
uaucaaauggcugagaagacu

SEQ ID NO: 2191 - RNA, 23 nt, Artificial Sequence
  Description of Artificial Sequence: Synthetic oligonucleotide
agucuucucagccauuugauauc

SEQ ID NO: 2192 - RNA, 21 nt, Artificial Sequence
  Description of Artificial Sequence: Synthetic oligonucleotide
auaucaaauggcugagaagac

SEQ ID NO: 2193 - RNA, 23 nt, Artificial Sequence
  Description of Artificial Sequence: Synthetic oligonucleotide
gucuucucagccauuugauaucu

SEQ ID NO: 2194 - RNA, 21 nt, Artificial Sequence
  Description of Artificial Sequence: Synthetic oligonucleotide
gugguucuuaaauuguaagcu

SEQ ID NO: 2195 - RNA, 23 nt, Artificial Sequence
  Description of Artificial Sequence: Synthetic oligonucleotide
agcuuacaauuuaagaaccacug

SEQ ID NO: 2196 - RNA, 21 nt, Artificial Sequence
  Description of Artificial Sequence: Synthetic oligonucleotide
ugguucuuaaauuguaagcuc

SEQ ID NO: 2197 - RNA, 23 nt, Artificial Sequence
  Description of Artificial Sequence: Synthetic oligonucleotide
gagcuuacaauuuaagaaccacu

SEQ ID NO: 2198 - RNA, 21 nt, Artificial Sequence
  Description of Artificial Sequence: Synthetic oligonucleotide
aacagugguucuuaaauugua

SEQ ID NO: 2199 - RNA, 23 nt, Artificial Sequence
  Description of Artificial Sequence: Synthetic oligonucleotide
uacaauuuaagaaccacuguuuu

SEQ ID NO: 2200 - RNA, 21 nt, Artificial Sequence
  Description of Artificial Sequence: Synthetic oligonucleotide
aaacagugguucuuaaauugu

SEQ ID NO: 2201 - RNA, 23 nt, Artificial Sequence
  Description of Artificial Sequence: Synthetic oligonucleotide
acaauuuaagaaccacuguuuua

SEQ ID NO: 2202 - RNA, 21 nt, Artificial Sequence
  Description of Artificial Sequence: Synthetic oligonucleotide
aagucaucgacaagacauugg

SEQ ID NO: 2203 - RNA, 23 nt, Artificial Sequence
  Description of Artificial Sequence: Synthetic oligonucleotide
ccaaugucuugucgaugacuuuc

SEQ ID NO: 2204 - RNA, 21 nt, Artificial Sequence
  Description of Artificial Sequence: Synthetic oligonucleotide
agucaucgacaagacauuggu

SEQ ID NO: 2205 - RNA, 23 nt, Artificial Sequence
  Description of Artificial Sequence: Synthetic oligonucleotide
accaaugucuugucgaugacuuu

SEQ ID NO: 2206 - RNA, 21 nt, Artificial Sequence
  Description of Artificial Sequence: Synthetic oligonucleotide
gugaaagucaucgacaagaca

SEQ ID NO: 2207 - RNA, 23 nt, Artificial Sequence
  Description of Artificial Sequence: Synthetic oligonucleotide
ugucuugucgaugacuuucacau

SEQ ID NO: 2208 - RNA, 21 nt, Artificial Sequence
  Description of Artificial Sequence: Synthetic oligonucleotide
ugugaaagucaucgacaagac

SEQ ID NO: 2209 - RNA, 23 nt, Artificial Sequence
  Description of Artificial Sequence: Synthetic oligonucleotide
gucuugucgaugacuuucacauu

SEQ ID NO: 2210 - RNA, 21 nt, Artificial Sequence
  Description of Artificial Sequence: Synthetic oligonucleotide
gauaauauugcagcauuuucc

SEQ ID NO: 2211 - RNA, 23 nt, Artificial Sequence
  Description of Artificial Sequence: Synthetic oligonucleotide
ggaaaaugcugcaauauuaucag

SEQ ID NO: 2212 - RNA, 21 nt, Artificial Sequence
  Description of Artificial Sequence: Synthetic oligonucleotide
auaauauugcagcauuuucca

SEQ ID NO: 2213 - RNA, 23 nt, Artificial Sequence
  Description of Artificial Sequence: Synthetic oligonucleotide
uggaaaaugcugcaauauuauca

SEQ ID NO: 2214 - RNA, 21 nt, Artificial Sequence
  Description of Artificial Sequence: Synthetic oligonucleotide
ggcugauaauauugcagcauu

SEQ ID NO: 2215 - RNA, 23 nt, Artificial Sequence
  Description of Artificial Sequence: Synthetic oligonucleotide
aaugcugcaauauuaucagccaa

SEQ ID NO: 2216 - RNA, 21 nt, Artificial Sequence
  Description of Artificial Sequence: Synthetic oligonucleotide
uggcugauaauauugcagcau

SEQ ID NO: 2217 - RNA, 23 nt, Artificial Sequence
  Description of Artificial Sequence: Synthetic oligonucleotide
augcugcaauauuaucagccaaa

SEQ ID NO: 2218 - RNA, 21 nt, Artificial Sequence
  Description of Artificial Sequence: Synthetic oligonucleotide
gcuaauuuguaucaaugauua

SEQ ID NO: 2219 - RNA, 23 nt, Artificial Sequence
  Description of Artificial Sequence: Synthetic oligonucleotide
uaaucauugauacaaauuagccg

SEQ ID NO: 2220 - RNA, 21 nt, Artificial Sequence
  Description of Artificial Sequence: Synthetic oligonucleotide
cuaauuuguaucaaugauuau

SEQ ID NO: 2221 - RNA, 23 nt, Artificial Sequence
  Description of Artificial Sequence: Synthetic oligonucleotide
auaaucauugauacaaauuagcc

SEQ ID NO: 2222 - RNA, 21 nt, Artificial Sequence
  Description of Artificial Sequence: Synthetic oligonucleotide
cccggcuaauuuguaucaaug

SEQ ID NO: 2223 - RNA, 23 nt, Artificial Sequence
  Description of Artificial Sequence: Synthetic oligonucleotide
cauugauacaaauuagccggggg

SEQ ID NO: 2224 - RNA, 21 nt, Artificial Sequence
  Description of Artificial Sequence: Synthetic oligonucleotide
ccccggcuaauuuguaucaau

SEQ ID NO: 2225 - RNA, 23 nt, Artificial Sequence
  Description of Artificial Sequence: Synthetic oligonucleotide
auugauacaaauuagccggggga

SEQ ID NO: 2226 - RNA, 21 nt, Artificial Sequence
  Description of Artificial Sequence: Synthetic oligonucleotide
uaauuggugauacuucuuuga

SEQ ID NO: 2227 - RNA, 23 nt, Artificial Sequence
  Description of Artificial Sequence: Synthetic oligonucleotide
ucaaagaaguaucaccaauuacc

SEQ ID NO: 2228 - RNA, 21 nt, Artificial Sequence
  Description of Artificial Sequence: Synthetic oligonucleotide
aauuggugauacuucuuugaa

SEQ ID NO: 2229 - RNA, 23 nt, Artificial Sequence
  Description of Artificial Sequence: Synthetic oligonucleotide
uucaaagaaguaucaccaauuac

SEQ ID NO: 2230 - RNA, 21 nt, Artificial Sequence
  Description of Artificial Sequence: Synthetic oligonucleotide
gcgguaauuggugauacuucu

SEQ ID NO: 2231 - RNA, 23 nt, Artificial Sequence
  Description of Artificial Sequence: Synthetic oligonucleotide
agaaguaucaccaauuaccgcca

SEQ ID NO: 2232 - RNA, 21 nt, Artificial Sequence
  Description of Artificial Sequence: Synthetic oligonucleotide
ggcgguaauuggugauacuuc

SEQ ID NO: 2233 - RNA, 23 nt, Artificial Sequence
  Description of Artificial Sequence: Synthetic oligonucleotide
gaaguaucaccaauuaccgccac

SEQ ID NO: 2234 - RNA, 21 nt, Artificial Sequence
  Description of Artificial Sequence: Synthetic oligonucleotide
cagugguucuuaaauuguaag

SEQ ID NO: 2235 - RNA, 23 nt, Artificial Sequence
  Description of Artificial Sequence: Synthetic oligonucleotide
cuuacaauuuaagaaccacuguu

SEQ ID NO: 2236 - RNA, 21 nt, Artificial Sequence
  Description of Artificial Sequence: Synthetic oligonucleotide
agugguucuuaaauuguaagc

SEQ ID NO: 2237 - RNA, 23 nt, Artificial Sequence
  Description of Artificial Sequence: Synthetic oligonucleotide
gcuuacaauuuaagaaccacugu

SEQ ID NO: 2238 - RNA, 21 nt, Artificial Sequence
  Description of Artificial Sequence: Synthetic oligonucleotide
aaaacagugguucuuaaauug

SEQ ID NO: 2239 - RNA, 23 nt, Artificial Sequence
  Description of Artificial Sequence: Synthetic oligonucleotide
caauuuaagaaccacuguuuuaa

SEQ ID NO: 2240 - RNA, 21 nt, Artificial Sequence
  Description of Artificial Sequence: Synthetic oligonucleotide
uaaaacagugguucuuaaauu

SEQ ID NO: 2241 - RNA, 23 nt, Artificial Sequence
  Description of Artificial Sequence: Synthetic oligonucleotide
aauuuaagaaccacuguuuuaaa

SEQ ID NO: 2242 - RNA, 21 nt, Artificial Sequence
  Description of Artificial Sequence: Synthetic oligonucleotide
accuguauucuguuuacaugu

SEQ ID NO: 2243 - RNA, 23 nt, Artificial Sequence
  Description of Artificial Sequence: Synthetic oligonucleotide
acauguaaacagaauacagguua

SEQ ID NO: 2244 - RNA, 21 nt, Artificial Sequence
  Description of Artificial Sequence: Synthetic oligonucleotide
ccuguauucuguuuacauguc

SEQ ID NO: 2245 - RNA, 23 nt, Artificial Sequence
  Description of Artificial Sequence: Synthetic oligonucleotide
gacauguaaacagaauacagguu

SEQ ID NO: 2246 - RNA, 21 nt, Artificial Sequence
  Description of Artificial Sequence: Synthetic oligonucleotide
auuaaccuguauucuguuuac

SEQ ID NO: 2247 - RNA, 23 nt, Artificial Sequence
  Description of Artificial Sequence: Synthetic oligonucleotide
guaaacagaauacagguuaauaa

SEQ ID NO: 2248 - RNA, 21 nt, Artificial Sequence
  Description of Artificial Sequence: Synthetic oligonucleotide
uauuaaccuguauucuguuua

SEQ ID NO: 2249 - RNA, 23 nt, Artificial Sequence
  Description of Artificial Sequence: Synthetic oligonucleotide
uaaacagaauacagguuaauaaa

SEQ ID NO: 2250 - RNA, 21 nt, Artificial Sequence
  Description of Artificial Sequence: Synthetic oligonucleotide
aagaaacuuuggcugauaaua

SEQ ID NO: 2251 - RNA, 23 nt, Artificial Sequence
  Description of Artificial Sequence: Synthetic oligonucleotide
uauuaucagccaaaguuucuuca

SEQ ID NO: 2252 - RNA, 21 nt, Artificial Sequence
  Description of Artificial Sequence: Synthetic oligonucleotide
agaaacuuuggcugauaauau

SEQ ID NO: 2253 - RNA, 23 nt, Artificial Sequence
  Description of Artificial Sequence: Synthetic oligonucleotide
auauuaucagccaaaguuucuuc

SEQ ID NO: 2254 - RNA, 21 nt, Artificial Sequence
  Description of Artificial Sequence: Synthetic oligonucleotide
gaugaagaaacuuuggcugau

SEQ ID NO: 2255 - RNA, 23 nt, Artificial Sequence
  Description of Artificial Sequence: Synthetic oligonucleotide
aucagccaaaguuucuucaucau

SEQ ID NO: 2256 - RNA, 21 nt, Artificial Sequence
  Description of Artificial Sequence: Synthetic oligonucleotide
ugaugaagaaacuuuggcuga

SEQ ID NO: 2257 - RNA, 23 nt, Artificial Sequence
  Description of Artificial Sequence: Synthetic oligonucleotide
ucagccaaaguuucuucaucauu

SEQ ID NO: 2258 - RNA, 21 nt, Artificial Sequence
  Description of Artificial Sequence: Synthetic oligonucleotide
gaaagguguucaagauguccu

SEQ ID NO: 2259 - RNA, 23 nt, Artificial Sequence
  Description of Artificial Sequence: Synthetic oligonucleotide
aggacaucuugaacaccuuucuc

SEQ ID NO: 2260 - RNA, 21 nt, Artificial Sequence
  Description of Artificial Sequence: Synthetic oligonucleotide
aaagguguucaagauguccuc

SEQ ID NO: 2261 - RNA, 23 nt, Artificial Sequence
  Description of Artificial Sequence: Synthetic oligonucleotide
gaggacaucuugaacaccuuucu

SEQ ID NO: 2262 - RNA, 21 nt, Artificial Sequence
  Description of Artificial Sequence: Synthetic oligonucleotide
gggagaaagguguucaagaug

SEQ ID NO: 2263 - RNA, 23 nt, Artificial Sequence
  Description of Artificial Sequence: Synthetic oligonucleotide
caucuugaacaccuuucuccccc

SEQ ID NO: 2264 - RNA, 21 nt, Artificial Sequence
  Description of Artificial Sequence: Synthetic oligonucleotide
ggggagaaagguguucaagau

SEQ ID NO: 2265 - RNA, 23 nt, Artificial Sequence
  Description of Artificial Sequence: Synthetic oligonucleotide
aucuugaacaccuuucucccccu

SEQ ID NO: 2266 - RNA, 21 nt, Artificial Sequence
  Description of Artificial Sequence: Synthetic oligonucleotide
aucuuggugucgaaucauggg

SEQ ID NO: 2267 - RNA, 23 nt, Artificial Sequence
  Description of Artificial Sequence: Synthetic oligonucleotide
cccaugauucgacaccaagaucc

SEQ ID NO: 2268 - RNA, 21 nt, Artificial Sequence
  Description of Artificial Sequence: Synthetic oligonucleotide
ucuuggugucgaaucaugggg

SEQ ID NO: 2269 - RNA, 23 nt, Artificial Sequence
  Description of Artificial Sequence: Synthetic oligonucleotide
ccccaugauucgacaccaagauc

SEQ ID NO: 2270 - RNA, 21 nt, Artificial Sequence
  Description of Artificial Sequence: Synthetic oligonucleotide
ugggaucuuggugucgaauca

SEQ ID NO: 2271 - RNA, 23 nt, Artificial Sequence
  Description of Artificial Sequence: Synthetic oligonucleotide
ugauucgacaccaagaucccauu

SEQ ID NO: 2272 - RNA, 21 nt, Artificial Sequence
  Description of Artificial Sequence: Synthetic oligonucleotide
augggaucuuggugucgaauc

SEQ ID NO: 2273 - RNA, 23 nt, Artificial Sequence
  Description of Artificial Sequence: Synthetic oligonucleotide
gauucgacaccaagaucccauuc

SEQ ID NO: 2274 - RNA, 21 nt, Artificial Sequence
  Description of Artificial Sequence: Synthetic oligonucleotide
gcuacaaggccauauuuguga

SEQ ID NO: 2275 - RNA, 23 nt, Artificial Sequence
  Description of Artificial Sequence: Synthetic oligonucleotide
ucacaaauauggccuuguagccc

SEQ ID NO: 2276 - RNA, 21 nt, Artificial Sequence
  Description of Artificial Sequence: Synthetic oligonucleotide
cuacaaggccauauuugugac

SEQ ID NO: 2277 - RNA, 23 nt, Artificial Sequence
  Description of Artificial Sequence: Synthetic oligonucleotide
gucacaaauauggccuuguagcc

SEQ ID NO: 2278 - RNA, 21 nt, Artificial Sequence
  Description of Artificial Sequence: Synthetic oligonucleotide
augggcuacaaggccauauuu

SEQ ID NO: 2279 - RNA, 23 nt, Artificial Sequence
  Description of Artificial Sequence: Synthetic oligonucleotide
aaauauggccuuguagcccaucu

SEQ ID NO: 2280 - RNA, 21 nt, Artificial Sequence
  Description of Artificial Sequence: Synthetic oligonucleotide
gaugggcuacaaggccauauu

SEQ ID NO: 2281 - RNA, 23 nt, Artificial Sequence
  Description of Artificial Sequence: Synthetic oligonucleotide
aauauggccuuguagcccaucuu

SEQ ID NO: 2282 - RNA, 21 nt, Artificial Sequence
  Description of Artificial Sequence: Synthetic oligonucleotide
acuggagagaauuggaauggg

SEQ ID NO: 2283 - RNA, 23 nt, Artificial Sequence
  Description of Artificial Sequence: Synthetic oligonucleotide
cccauuccaauucucuccagugc

SEQ ID NO: 2284 - RNA, 21 nt, Artificial Sequence
  Description of Artificial Sequence: Synthetic oligonucleotide
cuggagagaauuggaaugggu

SEQ ID NO: 2285 - RNA, 23 nt, Artificial Sequence
  Description of Artificial Sequence: Synthetic oligonucleotide
acccauuccaauucucuccagug

SEQ ID NO: 2286 - RNA, 21 nt, Artificial Sequence
  Description of Artificial Sequence: Synthetic oligonucleotide
uagcacuggagagaauuggaa

SEQ ID NO: 2287 - RNA, 23 nt, Artificial Sequence
  Description of Artificial Sequence: Synthetic oligonucleotide
uuccaauucucuccagugcuacc

SEQ ID NO: 2288 - RNA, 21 nt, Artificial Sequence
  Description of Artificial Sequence: Synthetic oligonucleotide
guagcacuggagagaauugga

SEQ ID NO: 2289 - RNA, 23 nt, Artificial Sequence
  Description of Artificial Sequence: Synthetic oligonucleotide
uccaauucucuccagugcuaccu

SEQ ID NO: 2290 - RNA, 21 nt, Artificial Sequence
  Description of Artificial Sequence: Synthetic oligonucleotide
acaguggacacaccuuaccug

SEQ ID NO: 2291 - RNA, 23 nt, Artificial Sequence
  Description of Artificial Sequence: Synthetic oligonucleotide
cagguaagguguguccacuguca

SEQ ID NO: 2292 - RNA, 21 nt, Artificial Sequence
  Description of Artificial Sequence: Synthetic oligonucleotide
caguggacacaccuuaccugg

SEQ ID NO: 2293 - RNA, 23 nt, Artificial Sequence
  Description of Artificial Sequence: Synthetic oligonucleotide
ccagguaagguguguccacuguc

SEQ ID NO: 2294 - RNA, 21 nt, Artificial Sequence
  Description of Artificial Sequence: Synthetic oligonucleotide
ugugacaguggacacaccuua

SEQ ID NO: 2295 - RNA, 23 nt, Artificial Sequence
  Description of Artificial Sequence: Synthetic oligonucleotide
uaagguguguccacugucacaaa

SEQ ID NO: 2296 - RNA, 21 nt, Artificial Sequence
  Description of Artificial Sequence: Synthetic oligonucleotide
uugugacaguggacacaccuu

SEQ ID NO: 2297 - RNA, 23 nt, Artificial Sequence
  Description of Artificial Sequence: Synthetic oligonucleotide
aagguguguccacugucacaaau

SEQ ID NO: 2298 - RNA, 21 nt, Artificial Sequence
  Description of Artificial Sequence: Synthetic oligonucleotide
gaagacugacaucauugccaa

SEQ ID NO: 2299 - RNA, 23 nt, Artificial Sequence
  Description of Artificial Sequence: Synthetic oligonucleotide
uuggcaaugaugucagucuucuc

SEQ ID NO: 2300 - RNA, 21 nt, Artificial Sequence
  Description of Artificial Sequence: Synthetic oligonucleotide
aagacugacaucauugccaau

SEQ ID NO: 2301 - RNA, 23 nt, Artificial Sequence
  Description of Artificial Sequence: Synthetic oligonucleotide
auuggcaaugaugucagucuucu

SEQ ID NO: 2302 - RNA, 21 nt, Artificial Sequence
  Description of Artificial Sequence: Synthetic oligonucleotide
cugagaagacugacaucauug

SEQ ID NO: 2303 - RNA, 23 nt, Artificial Sequence
  Description of Artificial Sequence: Synthetic oligonucleotide
caaugaugucagucuucucagcc

SEQ ID NO: 2304 - RNA, 21 nt, Artificial Sequence
  Description of Artificial Sequence: Synthetic oligonucleotide
gcugagaagacugacaucauu

SEQ ID NO: 2305 - RNA, 23 nt, Artificial Sequence
  Description of Artificial Sequence: Synthetic oligonucleotide
aaugaugucagucuucucagcca

SEQ ID NO: 2306 - RNA, 21 nt, Artificial Sequence
  Description of Artificial Sequence: Synthetic oligonucleotide
gcucagguucaaaguguuggu

SEQ ID NO: 2307 - RNA, 23 nt, Artificial Sequence
  Description of Artificial Sequence: Synthetic oligonucleotide
accaacacuuugaaccugagcuu

SEQ ID NO: 2308 - RNA, 21 nt, Artificial Sequence
  Description of Artificial Sequence: Synthetic oligonucleotide
cucagguucaaaguguuggua

SEQ ID NO: 2309 - RNA, 23 nt, Artificial Sequence
  Description of Artificial Sequence: Synthetic oligonucleotide
uaccaacacuuugaaccugagcu

SEQ ID NO: 2310 - RNA, 21 nt, Artificial Sequence
  Description of Artificial Sequence: Synthetic oligonucleotide
guaagcucagguucaaagugu

SEQ ID NO: 2311 - RNA, 23 nt, Artificial Sequence
  Description of Artificial Sequence: Synthetic oligonucleotide
acacuuugaaccugagcuuacaa

SEQ ID NO: 2312 - RNA, 21 nt, Artificial Sequence
  Description of Artificial Sequence: Synthetic oligonucleotide
uguaagcucagguucaaagug

SEQ ID NO: 2313 - RNA, 23 nt, Artificial Sequence
  Description of Artificial Sequence: Synthetic oligonucleotide
cacuuugaaccugagcuuacaau

SEQ ID NO: 2314 - RNA, 21 nt, Artificial Sequence
  Description of Artificial Sequence: Synthetic oligonucleotide
auguauuacuugacaaagaga

SEQ ID NO: 2315 - RNA, 23 nt, Artificial Sequence
  Description of Artificial Sequence: Synthetic oligonucleotide
ucucuuugucaaguaauacaugc

SEQ ID NO: 2316 - RNA, 21 nt, Artificial Sequence
  Description of Artificial Sequence: Synthetic oligonucleotide
uguauuacuugacaaagagac

SEQ ID NO: 2317 - RNA, 23 nt, Artificial Sequence
  Description of Artificial Sequence: Synthetic oligonucleotide
gucucuuugucaaguaauacaug

SEQ ID NO: 2318 - RNA, 21 nt, Artificial Sequence
  Description of Artificial Sequence: Synthetic oligonucleotide
cagcauguauuacuugacaaa

SEQ ID NO: 2319 - RNA, 23 nt, Artificial Sequence
  Description of Artificial Sequence: Synthetic oligonucleotide
uuugucaaguaauacaugcugaa

SEQ ID NO: 2320 - RNA, 21 nt, Artificial Sequence
  Description of Artificial Sequence: Synthetic oligonucleotide
ucagcauguauuacuugacaa

SEQ ID NO: 2321 - RNA, 23 nt, Artificial Sequence
  Description of Artificial Sequence: Synthetic oligonucleotide
uugucaaguaauacaugcugaaa

SEQ ID NO: 2322 - RNA, 21 nt, Artificial Sequence
  Description of Artificial Sequence: Synthetic oligonucleotide
cugcaacuguauaucuacaag

SEQ ID NO: 2323 - RNA, 23 nt, Artificial Sequence
  Description of Artificial Sequence: Synthetic oligonucleotide
cuuguagauauacaguugcagcc

SEQ ID NO: 2324 - RNA, 21 nt, Artificial Sequence
  Description of Artificial Sequence: Synthetic oligonucleotide
ugcaacuguauaucuacaagg

SEQ ID NO: 2325 - RNA, 23 nt, Artificial Sequence
  Description of Artificial Sequence: Synthetic oligonucleotide
ccuuguagauauacaguugcagc

SEQ ID NO: 2326 - RNA, 21 nt, Artificial Sequence
  Description of Artificial Sequence: Synthetic oligonucleotide
uuggcugcaacuguauaucua

SEQ ID NO: 2327 - RNA, 23 nt, Artificial Sequence
  Description of Artificial Sequence: Synthetic oligonucleotide
uagauauacaguugcagccaacg

SEQ ID NO: 2328 - RNA, 21 nt, Artificial Sequence
  Description of Artificial Sequence: Synthetic oligonucleotide
guuggcugcaacuguauaucu

SEQ ID NO: 2329 - RNA, 23 nt, Artificial Sequence
  Description of Artificial Sequence: Synthetic oligonucleotide
agauauacaguugcagccaacga

SEQ ID NO: 2330 - RNA, 21 nt, Artificial Sequence
  Description of Artificial Sequence: Synthetic oligonucleotide
caaaugaugaagaaacuuugg

SEQ ID NO: 2331 - RNA, 23 nt, Artificial Sequence
  Description of Artificial Sequence: Synthetic oligonucleotide
ccaaaguuucuucaucauuugcc

SEQ ID NO: 2332 - RNA, 21 nt, Artificial Sequence
  Description of Artificial Sequence: Synthetic oligonucleotide
aaaugaugaagaaacuuuggc

SEQ ID NO: 2333 - RNA, 23 nt, Artificial Sequence
  Description of Artificial Sequence: Synthetic oligonucleotide
gccaaaguuucuucaucauuugc

SEQ ID NO: 2334 - RNA, 21 nt, Artificial Sequence
  Description of Artificial Sequence: Synthetic oligonucleotide
ggggcaaaugaugaagaaacu

SEQ ID NO: 2335 - RNA, 23 nt, Artificial Sequence
  Description of Artificial Sequence: Synthetic oligonucleotide
aguuucuucaucauuugccccag

SEQ ID NO: 2336 - RNA, 21 nt, Artificial Sequence
  Description of Artificial Sequence: Synthetic oligonucleotide
uggggcaaaugaugaagaaac

SEQ ID NO: 2337 - RNA, 23 nt, Artificial Sequence
  Description of Artificial Sequence: Synthetic oligonucleotide
guuucuucaucauuugccccaga

SEQ ID NO: 2338 - RNA, 21 nt, Artificial Sequence
  Description of Artificial Sequence: Synthetic oligonucleotide
caaagggugucguucuuuucc

SEQ ID NO: 2339 - RNA, 23 nt, Artificial Sequence
  Description of Artificial Sequence: Synthetic oligonucleotide
ggaaaagaacgacacccuuugua

SEQ ID NO: 2340 - RNA, 21 nt, Artificial Sequence
  Description of Artificial Sequence: Synthetic oligonucleotide
aaagggugucguucuuuucca

SEQ ID NO: 2341 - RNA, 23 nt, Artificial Sequence
  Description of Artificial Sequence: Synthetic oligonucleotide
uggaaaagaacgacacccuuugu

SEQ ID NO: 2342 - RNA, 21 nt, Artificial Sequence
  Description of Artificial Sequence: Synthetic oligonucleotide
aauacaaagggugucguucuu

SEQ ID NO: 2343 - RNA, 23 nt, Artificial Sequence
  Description of Artificial Sequence: Synthetic oligonucleotide
aagaacgacacccuuuguauuga

SEQ ID NO: 2344 - RNA, 21 nt, Artificial Sequence
  Description of Artificial Sequence: Synthetic oligonucleotide
caauacaaagggugucguucu

SEQ ID NO: 2345 - RNA, 23 nt, Artificial Sequence
  Description of Artificial Sequence: Synthetic oligonucleotide
agaacgacacccuuuguauugaa

SEQ ID NO: 2346 - RNA, 21 nt, Artificial Sequence
  Description of Artificial Sequence: Synthetic oligonucleotide
aaaggcacugauguucugaaa

SEQ ID NO: 2347 - RNA, 23 nt, Artificial Sequence
  Description of Artificial Sequence: Synthetic oligonucleotide
uuucagaacaucagugccuuucc

SEQ ID NO: 2348 - RNA, 21 nt, Artificial Sequence
  Description of Artificial Sequence: Synthetic oligonucleotide
aaggcacugauguucugaaag

SEQ ID NO: 2349 - RNA, 23 nt, Artificial Sequence
  Description of Artificial Sequence: Synthetic oligonucleotide
cuuucagaacaucagugccuuuc

SEQ ID NO: 2350 - RNA, 21 nt, Artificial Sequence
  Description of Artificial Sequence: Synthetic oligonucleotide
gcggaaaggcacugauguucu

SEQ ID NO: 2351 - RNA, 23 nt, Artificial Sequence
  Description of Artificial Sequence: Synthetic oligonucleotide
agaacaucagugccuuuccgcac

SEQ ID NO: 2352 - RNA, 21 nt, Artificial Sequence
  Description of Artificial Sequence: Synthetic oligonucleotide
ugcggaaaggcacugauguuc

SEQ ID NO: 2353 - RNA, 23 nt, Artificial Sequence
  Description of Artificial Sequence: Synthetic oligonucleotide
gaacaucagugccuuuccgcaca

SEQ ID NO: 2354 - RNA, 21 nt, Artificial Sequence
  Description of Artificial Sequence: Synthetic oligonucleotide
aaggaugcuccggaauguugc

SEQ ID NO: 2355 - RNA, 23 nt, Artificial Sequence
  Description of Artificial Sequence: Synthetic oligonucleotide
gcaacauuccggagcauccuugg

SEQ ID NO: 2356 - RNA, 21 nt, Artificial Sequence
  Description of Artificial Sequence: Synthetic oligonucleotide
aggaugcuccggaauguugcu

SEQ ID NO: 2357 - RNA, 23 nt, Artificial Sequence
  Description of Artificial Sequence: Synthetic oligonucleotide
agcaacauuccggagcauccuug

SEQ ID NO: 2358 - RNA, 21 nt, Artificial Sequence
  Description of Artificial Sequence: Synthetic oligonucleotide
auccaaggaugcuccggaaug

SEQ ID NO: 2359 - RNA, 23 nt, Artificial Sequence
  Description of Artificial Sequence: Synthetic oligonucleotide
cauuccggagcauccuuggauac

SEQ ID NO: 2360 - RNA, 21 nt, Artificial Sequence
  Description of Artificial Sequence: Synthetic oligonucleotide
uauccaaggaugcuccggaau

SEQ ID NO: 2361 - RNA, 23 nt, Artificial Sequence
  Description of Artificial Sequence: Synthetic oligonucleotide
auuccggagcauccuuggauaca

SEQ ID NO: 2362 - RNA, 21 nt, Artificial Sequence
  Description of Artificial Sequence: Synthetic oligonucleotide
aauggguggcgguaauuggug

SEQ ID NO: 2363 - RNA, 23 nt, Artificial Sequence
  Description of Artificial Sequence: Synthetic oligonucleotide
caccaauuaccgccacccauucc

SEQ ID NO: 2364 - RNA, 21 nt, Artificial Sequence
  Description of Artificial Sequence: Synthetic oligonucleotide
auggguggcgguaauugguga

SEQ ID NO: 2365 - RNA, 23 nt, Artificial Sequence
  Description of Artificial Sequence: Synthetic oligonucleotide
ucaccaauuaccgccacccauuc

SEQ ID NO: 2366 - RNA, 21 nt, Artificial Sequence
  Description of Artificial Sequence: Synthetic oligonucleotide
uuggaauggguggcgguaauu

SEQ ID NO: 2367 - RNA, 23 nt, Artificial Sequence
  Description of Artificial Sequence: Synthetic oligonucleotide
aauuaccgccacccauuccaauu

SEQ ID NO: 2368 - RNA, 21 nt, Artificial Sequence
  Description of Artificial Sequence: Synthetic oligonucleotide
auuggaauggguggcgguaau

SEQ ID NO: 2369 - RNA, 23 nt, Artificial Sequence
  Description of Artificial Sequence: Synthetic oligonucleotide
auuaccgccacccauuccaauuc

SEQ ID NO: 2370 - RNA, 21 nt, Artificial Sequence
  Description of Artificial Sequence: Synthetic oligonucleotide
ggaaaggcacugauguucuga

SEQ ID NO: 2371 - RNA, 23 nt, Artificial Sequence
  Description of Artificial Sequence: Synthetic oligonucleotide
ucagaacaucagugccuuuccgc

SEQ ID NO: 2372 - RNA, 21 nt, Artificial Sequence
  Description of Artificial Sequence: Synthetic oligonucleotide
gaaaggcacugauguucugaa

SEQ ID NO: 2373 - RNA, 23 nt, Artificial Sequence
  Description of Artificial Sequence: Synthetic oligonucleotide
uucagaacaucagugccuuuccg

SEQ ID NO: 2374 - RNA, 21 nt, Artificial Sequence
  Description of Artificial Sequence: Synthetic oligonucleotide
gugcggaaaggcacugauguu

SEQ ID NO: 2375 - RNA, 23 nt, Artificial Sequence
  Description of Artificial Sequence: Synthetic oligonucleotide
aacaucagugccuuuccgcacac

SEQ ID NO: 2376 - RNA, 21 nt, Artificial Sequence
  Description of Artificial Sequence: Synthetic oligonucleotide
ugugcggaaaggcacugaugu

SEQ ID NO: 2377 - RNA, 23 nt, Artificial Sequence
  Description of Artificial Sequence: Synthetic oligonucleotide
acaucagugccuuuccgcacacc

SEQ ID NO: 2378 - RNA, 21 nt, Artificial Sequence
  Description of Artificial Sequence: Synthetic oligonucleotide
aauuguaagcucagguucaaa

SEQ ID NO: 2379 - RNA, 23 nt, Artificial Sequence
  Description of Artificial Sequence: Synthetic oligonucleotide
uuugaaccugagcuuacaauuua

SEQ ID NO: 2380 - RNA, 21 nt, Artificial Sequence
  Description of Artificial Sequence: Synthetic oligonucleotide
auuguaagcucagguucaaag

SEQ ID NO: 2381 - RNA, 23 nt, Artificial Sequence
  Description of Artificial Sequence: Synthetic oligonucleotide
cuuugaaccugagcuuacaauuu

SEQ ID NO: 2382 - RNA, 21 nt, Artificial Sequence
  Description of Artificial Sequence: Synthetic oligonucleotide
cuuaaauuguaagcucagguu

SEQ ID NO: 2383 - RNA, 23 nt, Artificial Sequence
  Description of Artificial Sequence: Synthetic oligonucleotide
aaccugagcuuacaauuuaagaa

SEQ ID NO: 2384 - RNA, 21 nt, Artificial Sequence
  Description of Artificial Sequence: Synthetic oligonucleotide
ucuuaaauuguaagcucaggu

SEQ ID NO: 2385 - RNA, 23 nt, Artificial Sequence
  Description of Artificial Sequence: Synthetic oligonucleotide
accugagcuuacaauuuaagaac

SEQ ID NO: 2386 - RNA, 21 nt, Artificial Sequence
  Description of Artificial Sequence: Synthetic oligonucleotide
gcaaacacuaaggugaaaaga

SEQ ID NO: 2387 - RNA, 23 nt, Artificial Sequence
  Description of Artificial Sequence: Synthetic oligonucleotide
ucuuuucaccuuaguguuugcua

SEQ ID NO: 2388 - RNA, 21 nt, Artificial Sequence
  Description of Artificial Sequence: Synthetic oligonucleotide
caaacacuaaggugaaaagau

SEQ ID NO: 2389 - RNA, 23 nt, Artificial Sequence
  Description of Artificial Sequence: Synthetic oligonucleotide
aucuuuucaccuuaguguuugcu

SEQ ID NO: 2390 - RNA, 21 nt, Artificial Sequence
  Description of Artificial Sequence: Synthetic oligonucleotide
gguagcaaacacuaaggugaa

SEQ ID NO: 2391 - RNA, 23 nt, Artificial Sequence
  Description of Artificial Sequence: Synthetic oligonucleotide
uucaccuuaguguuugcuaccuc

SEQ ID NO: 2392 - RNA, 21 nt, Artificial Sequence
  Description of Artificial Sequence: Synthetic oligonucleotide
agguagcaaacacuaagguga

SEQ ID NO: 2393 - RNA, 23 nt, Artificial Sequence
  Description of Artificial Sequence: Synthetic oligonucleotide
ucaccuuaguguuugcuaccucc

SEQ ID NO: 2394 - RNA, 21 nt, Artificial Sequence
  Description of Artificial Sequence: Synthetic oligonucleotide
agguagcaaacacuaagguga

SEQ ID NO: 2395 - RNA, 23 nt, Artificial Sequence
  Description of Artificial Sequence: Synthetic oligonucleotide
ucaccuuaguguuugcuaccucc

SEQ ID NO: 2396 - RNA, 21 nt, Artificial Sequence
  Description of Artificial Sequence: Synthetic oligonucleotide
gguagcaaacacuaaggugaa

SEQ ID NO: 2397 - RNA, 23 nt, Artificial Sequence
  Description of Artificial Sequence: Synthetic oligonucleotide
uucaccuuaguguuugcuaccuc

SEQ ID NO: 2398 - RNA, 21 nt, Artificial Sequence
  Description of Artificial Sequence: Synthetic oligonucleotide
uuggagguagcaaacacuaag

SEQ ID NO: 2399 - RNA, 23 nt, Artificial Sequence
  Description of Artificial Sequence: Synthetic oligonucleotide
cuuaguguuugcuaccuccaauu

SEQ ID NO: 2400 - RNA, 21 nt, Artificial Sequence
  Description of Artificial Sequence: Synthetic oligonucleotide
auuggagguagcaaacacuaa

SEQ ID NO: 2401 - RNA, 23 nt, Artificial Sequence
  Description of Artificial Sequence: Synthetic oligonucleotide
uuaguguuugcuaccuccaauuu

SEQ ID NO: 2402 - RNA, 21 nt, Artificial Sequence
  Description of Artificial Sequence: Synthetic oligonucleotide
uaaagugcuguauccuuuagu

SEQ ID NO: 2403 - RNA, 23 nt, Artificial Sequence
  Description of Artificial Sequence: Synthetic oligonucleotide
acuaaaggauacagcacuuuagc

SEQ ID NO: 2404 - RNA, 21 nt, Artificial Sequence
  Description of Artificial Sequence: Synthetic oligonucleotide
aaagugcuguauccuuuagua

SEQ ID NO: 2405 - RNA, 23 nt, Artificial Sequence
  Description of Artificial Sequence: Synthetic oligonucleotide
uacuaaaggauacagcacuuuag

SEQ ID NO: 2406 - RNA, 21 nt, Artificial Sequence
  Description of Artificial Sequence: Synthetic oligonucleotide
aggcuaaagugcuguauccuu

SEQ ID NO: 2407 - RNA, 23 nt, Artificial Sequence
  Description of Artificial Sequence: Synthetic oligonucleotide
aaggauacagcacuuuagccugc

SEQ ID NO: 2408 - RNA, 21 nt, Artificial Sequence
  Description of Artificial Sequence: Synthetic oligonucleotide
caggcuaaagugcuguauccu

SEQ ID NO: 2409 - RNA, 23 nt, Artificial Sequence
  Description of Artificial Sequence: Synthetic oligonucleotide
aggauacagcacuuuagccugcc

SEQ ID NO: 2410 - RNA, 21 nt, Artificial Sequence
  Description of Artificial Sequence: Synthetic oligonucleotide
aagacauuggugaggaaaaau

SEQ ID NO: 2411 - RNA, 23 nt, Artificial Sequence
  Description of Artificial Sequence: Synthetic oligonucleotide
auuuuuccucaccaaugucuugu

SEQ ID NO: 2412 - RNA, 21 nt, Artificial Sequence
  Description of Artificial Sequence: Synthetic oligonucleotide
agacauuggugaggaaaaauc

SEQ ID NO: 2413 - RNA, 23 nt, Artificial Sequence
  Description of Artificial Sequence: Synthetic oligonucleotide
gauuuuuccucaccaaugucuug

SEQ ID NO: 2414 - RNA, 21 nt, Artificial Sequence
  Description of Artificial Sequence: Synthetic oligonucleotide
cgacaagacauuggugaggaa

SEQ ID NO: 2415 - RNA, 23 nt, Artificial Sequence
  Description of Artificial Sequence: Synthetic oligonucleotide
uuccucaccaaugucuugucgau

SEQ ID NO: 2416 - RNA, 21 nt, Artificial Sequence
  Description of Artificial Sequence: Synthetic oligonucleotide
ucgacaagacauuggugagga

SEQ ID NO: 2417 - RNA, 23 nt, Artificial Sequence
  Description of Artificial Sequence: Synthetic oligonucleotide
uccucaccaaugucuugucgaug

SEQ ID NO: 2418 - RNA, 21 nt, Artificial Sequence
  Description of Artificial Sequence: Synthetic oligonucleotide
aagauguccucgagauacuaa

SEQ ID NO: 2419 - RNA, 23 nt, Artificial Sequence
  Description of Artificial Sequence: Synthetic oligonucleotide
uuaguaucucgaggacaucuuga

SEQ ID NO: 2420 - RNA, 21 nt, Artificial Sequence
  Description of Artificial Sequence: Synthetic oligonucleotide
agauguccucgagauacuaaa

SEQ ID NO: 2421 - RNA, 23 nt, Artificial Sequence
  Description of Artificial Sequence: Synthetic oligonucleotide
uuuaguaucucgaggacaucuug

SEQ ID NO: 2422 - RNA, 21 nt, Artificial Sequence
  Description of Artificial Sequence: Synthetic oligonucleotide
guucaagauguccucgagaua

SEQ ID NO: 2423 - RNA, 23 nt, Artificial Sequence
  Description of Artificial Sequence: Synthetic oligonucleotide
uaucucgaggacaucuugaacac

SEQ ID NO: 2424 - RNA, 21 nt, Artificial Sequence
  Description of Artificial Sequence: Synthetic oligonucleotide
uguucaagauguccucgagau

SEQ ID NO: 2425 - RNA, 23 nt, Artificial Sequence
  Description of Artificial Sequence: Synthetic oligonucleotide
aucucgaggacaucuugaacacc

SEQ ID NO: 2426 - RNA, 21 nt, Artificial Sequence
  Description of Artificial Sequence: Synthetic oligonucleotide
gagaaagguguucaagauguc

SEQ ID NO: 2427 - RNA, 23 nt, Artificial Sequence
  Description of Artificial Sequence: Synthetic oligonucleotide
gacaucuugaacaccuuucuccc

SEQ ID NO: 2428 - RNA, 21 nt, Artificial Sequence
  Description of Artificial Sequence: Synthetic oligonucleotide
agaaagguguucaagaugucc

SEQ ID NO: 2429 - RNA, 23 nt, Artificial Sequence
  Description of Artificial Sequence: Synthetic oligonucleotide
ggacaucuugaacaccuuucucc

SEQ ID NO: 2430 - RNA, 21 nt, Artificial Sequence
  Description of Artificial Sequence: Synthetic oligonucleotide
gggggagaaagguguucaaga

SEQ ID NO: 2431 - RNA, 23 nt, Artificial Sequence
  Description of Artificial Sequence: Synthetic oligonucleotide
ucuugaacaccuuucucccccug

SEQ ID NO: 2432 - RNA, 21 nt, Artificial Sequence
  Description of Artificial Sequence: Synthetic oligonucleotide
agggggagaaagguguucaag

SEQ ID NO: 2433 - RNA, 23 nt, Artificial Sequence
  Description of Artificial Sequence: Synthetic oligonucleotide
cuugaacaccuuucucccccugg

SEQ ID NO: 2434 - RNA, 21 nt, Artificial Sequence
  Description of Artificial Sequence: Synthetic oligonucleotide
gcugggaagauaucaaauggc

SEQ ID NO: 2435 - RNA, 23 nt, Artificial Sequence
  Description of Artificial Sequence: Synthetic oligonucleotide
gccauuugauaucuucccagcug

SEQ ID NO: 2436 - RNA, 21 nt, Artificial Sequence
  Description of Artificial Sequence: Synthetic oligonucleotide
cugggaagauaucaaauggcu

SEQ ID NO: 2437 - RNA, 23 nt, Artificial Sequence
  Description of Artificial Sequence: Synthetic oligonucleotide
agccauuugauaucuucccagcu

SEQ ID NO: 2438 - RNA, 21 nt, Artificial Sequence
  Description of Artificial Sequence: Synthetic oligonucleotide
aucagcugggaagauaucaaa

SEQ ID NO: 2439 - RNA, 23 nt, Artificial Sequence
  Description of Artificial Sequence: Synthetic oligonucleotide
uuugauaucuucccagcugauag

SEQ ID NO: 2440 - RNA, 21 nt, Artificial Sequence
  Description of Artificial Sequence: Synthetic oligonucleotide
uaucagcugggaagauaucaa

SEQ ID NO: 2441 - RNA, 23 nt, Artificial Sequence
  Description of Artificial Sequence: Synthetic oligonucleotide
uugauaucuucccagcugauaga

SEQ ID NO: 2442 - RNA, 21 nt, Artificial Sequence
  Description of Artificial Sequence: Synthetic oligonucleotide
ucugucgacuucuguuuuagg

SEQ ID NO: 2443 - RNA, 23 nt, Artificial Sequence
  Description of Artificial Sequence: Synthetic oligonucleotide
ccuaaaacagaagucgacagauc

SEQ ID NO: 2444 - RNA, 21 nt, Artificial Sequence
  Description of Artificial Sequence: Synthetic oligonucleotide
cugucgacuucuguuuuagga

SEQ ID NO: 2445 - RNA, 23 nt, Artificial Sequence
  Description of Artificial Sequence: Synthetic oligonucleotide
uccuaaaacagaagucgacagau

SEQ ID NO: 2446 - RNA, 21 nt, Artificial Sequence
  Description of Artificial Sequence: Synthetic oligonucleotide
cagaucugucgacuucuguuu

SEQ ID NO: 2447 - RNA, 23 nt, Artificial Sequence
  Description of Artificial Sequence: Synthetic oligonucleotide
aaacagaagucgacagaucuguu

SEQ ID NO: 2448 - RNA, 21 nt, Artificial Sequence
  Description of Artificial Sequence: Synthetic oligonucleotide
acagaucugucgacuucuguu

SEQ ID NO: 2449 - RNA, 23 nt, Artificial Sequence
  Description of Artificial Sequence: Synthetic oligonucleotide
aacagaagucgacagaucuguuu

SEQ ID NO: 2450 - RNA, 21 nt, Artificial Sequence
  Description of Artificial Sequence: Synthetic oligonucleotide
uacuucuuugaauguagauuu

SEQ ID NO: 2451 - RNA, 23 nt, Artificial Sequence
  Description of Artificial Sequence: Synthetic oligonucleotide
aaaucuacauucaaagaaguauc

SEQ ID NO: 2452 - RNA, 21 nt, Artificial Sequence
  Description of Artificial Sequence: Synthetic oligonucleotide
acuucuuugaauguagauuuc

SEQ ID NO: 2453 - RNA, 23 nt, Artificial Sequence
  Description of Artificial Sequence: Synthetic oligonucleotide
gaaaucuacauucaaagaaguau

SEQ ID NO: 2454 - RNA, 21 nt, Artificial Sequence
  Description of Artificial Sequence: Synthetic oligonucleotide
gugauacuucuuugaauguag

SEQ ID NO: 2455 - RNA, 23 nt, Artificial Sequence
  Description of Artificial Sequence: Synthetic oligonucleotide
cuacauucaaagaaguaucacca

SEQ ID NO: 2456 - RNA, 21 nt, Artificial Sequence
  Description of Artificial Sequence: Synthetic oligonucleotide
ggugauacuucuuugaaugua

SEQ ID NO: 2457 - RNA, 23 nt, Artificial Sequence
  Description of Artificial Sequence: Synthetic oligonucleotide
uacauucaaagaaguaucaccaa

SEQ ID NO: 2458 - RNA, 21 nt, Artificial Sequence
  Description of Artificial Sequence: Synthetic oligonucleotide
ugggaagauaucaaauggcug

SEQ ID NO: 2459 - RNA, 23 nt, Artificial Sequence
  Description of Artificial Sequence: Synthetic oligonucleotide
cagccauuugauaucuucccagc

SEQ ID NO: 2460 - RNA, 21 nt, Artificial Sequence
  Description of Artificial Sequence: Synthetic oligonucleotide
gggaagauaucaaauggcuga

SEQ ID NO: 2461 - RNA, 23 nt, Artificial Sequence
  Description of Artificial Sequence: Synthetic oligonucleotide
ucagccauuugauaucuucccag

SEQ ID NO: 2462 - RNA, 21 nt, Artificial Sequence
  Description of Artificial Sequence: Synthetic oligonucleotide
cagcugggaagauaucaaaug

SEQ ID NO: 2463 - RNA, 23 nt, Artificial Sequence
  Description of Artificial Sequence: Synthetic oligonucleotide
cauuugauaucuucccagcugau

SEQ ID NO: 2464 - RNA, 21 nt, Artificial Sequence
  Description of Artificial Sequence: Synthetic oligonucleotide
ucagcugggaagauaucaaau

SEQ ID NO: 2465 - RNA, 23 nt, Artificial Sequence
  Description of Artificial Sequence: Synthetic oligonucleotide
auuugauaucuucccagcugaua

SEQ ID NO: 2466 - RNA, 21 nt, Artificial Sequence
  Description of Artificial Sequence: Synthetic oligonucleotide
uccaaagucuauauaugacua

SEQ ID NO: 2467 - RNA, 23 nt, Artificial Sequence
  Description of Artificial Sequence: Synthetic oligonucleotide
uagucauauauagacuuuggaag

SEQ ID NO: 2468 - RNA, 21 nt, Artificial Sequence
  Description of Artificial Sequence: Synthetic oligonucleotide
ccaaagucuauauaugacuau

SEQ ID NO: 2469 - RNA, 23 nt, Artificial Sequence
  Description of Artificial Sequence: Synthetic oligonucleotide
auagucauauauagacuuuggaa

SEQ ID NO: 2470 - RNA, 21 nt, Artificial Sequence
  Description of Artificial Sequence: Synthetic oligonucleotide
uacuuccaaagucuauauaug

SEQ ID NO: 2471 - RNA, 23 nt, Artificial Sequence
  Description of Artificial Sequence: Synthetic oligonucleotide
cauauauagacuuuggaaguacu

SEQ ID NO: 2472 - RNA, 21 nt, Artificial Sequence
  Description of Artificial Sequence: Synthetic oligonucleotide
guacuuccaaagucuauauau

SEQ ID NO: 2473 - RNA, 23 nt, Artificial Sequence
  Description of Artificial Sequence: Synthetic oligonucleotide
auauauagacuuuggaaguacug

SEQ ID NO: 2474 - RNA, 21 nt, Artificial Sequence
  Description of Artificial Sequence: Synthetic oligonucleotide
uuaugaacaacaugcuaaauc

SEQ ID NO: 2475 - RNA, 23 nt, Artificial Sequence
  Description of Artificial Sequence: Synthetic oligonucleotide
gauuuagcauguuguucauaauc

SEQ ID NO: 2476 - RNA, 21 nt, Artificial Sequence
  Description of Artificial Sequence: Synthetic oligonucleotide
uaugaacaacaugcuaaauca

SEQ ID NO: 2477 - RNA, 23 nt, Artificial Sequence
  Description of Artificial Sequence: Synthetic oligonucleotide
ugauuuagcauguuguucauaau

SEQ ID NO: 2478 - RNA, 21 nt, Artificial Sequence
  Description of Artificial Sequence: Synthetic oligonucleotide
augauuaugaacaacaugcua

SEQ ID NO: 2479 - RNA, 23 nt, Artificial Sequence
  Description of Artificial Sequence: Synthetic oligonucleotide
uagcauguuguucauaaucauug

SEQ ID NO: 2480 - RNA, 21 nt, Artificial Sequence
  Description of Artificial Sequence: Synthetic oligonucleotide
aaugauuaugaacaacaugcu

SEQ ID NO: 2481 - RNA, 23 nt, Artificial Sequence
  Description of Artificial Sequence: Synthetic oligonucleotide
agcauguuguucauaaucauuga

SEQ ID NO: 2482 - RNA, 21 nt, Artificial Sequence
  Description of Artificial Sequence: Synthetic oligonucleotide
aauuccccacuucaauacaaa

SEQ ID NO: 2483 - RNA, 23 nt, Artificial Sequence
  Description of Artificial Sequence: Synthetic oligonucleotide
uuuguauugaaguggggaauuac

SEQ ID NO: 2484 - RNA, 21 nt, Artificial Sequence
  Description of Artificial Sequence: Synthetic oligonucleotide
auuccccacuucaauacaaag

SEQ ID NO: 2485 - RNA, 23 nt, Artificial Sequence
  Description of Artificial Sequence: Synthetic oligonucleotide
cuuuguauugaaguggggaauua

SEQ ID NO: 2486 - RNA, 21 nt, Artificial Sequence
  Description of Artificial Sequence: Synthetic oligonucleotide
cuguaauuccccacuucaaua

SEQ ID NO: 2487 - RNA, 23 nt, Artificial Sequence
  Description of Artificial Sequence: Synthetic oligonucleotide
uauugaaguggggaauuacagac

SEQ ID NO: 2488 - RNA, 21 nt, Artificial Sequence
  Description of Artificial Sequence: Synthetic oligonucleotide
ucuguaauuccccacuucaau

SEQ ID NO: 2489 - RNA, 23 nt, Artificial Sequence
  Description of Artificial Sequence: Synthetic oligonucleotide
auugaaguggggaauuacagacu

SEQ ID NO: 2490 - RNA, 21 nt, Artificial Sequence
  Description of Artificial Sequence: Synthetic oligonucleotide
ugaugugcguaacagauucaa

SEQ ID NO: 2491 - RNA, 23 nt, Artificial Sequence
  Description of Artificial Sequence: Synthetic oligonucleotide
uugaaucuguuacgcacaucauc

SEQ ID NO: 2492 - RNA, 21 nt, Artificial Sequence
  Description of Artificial Sequence: Synthetic oligonucleotide
gaugugcguaacagauucaaa

SEQ ID NO: 2493 - RNA, 23 nt, Artificial Sequence
  Description of Artificial Sequence: Synthetic oligonucleotide
uuugaaucuguuacgcacaucau

SEQ ID NO: 2494 - RNA, 21 nt, Artificial Sequence
  Description of Artificial Sequence: Synthetic oligonucleotide
uggaugaugugcguaacagau

SEQ ID NO: 2495 - RNA, 23 nt, Artificial Sequence
  Description of Artificial Sequence: Synthetic oligonucleotide
aucuguuacgcacaucauccaga

SEQ ID NO: 2496 - RNA, 21 nt, Artificial Sequence
  Description of Artificial Sequence: Synthetic oligonucleotide
cuggaugaugugcguaacaga

SEQ ID NO: 2497 - RNA, 23 nt, Artificial Sequence
  Description of Artificial Sequence: Synthetic oligonucleotide
ucuguuacgcacaucauccagac

SEQ ID NO: 2498 - RNA, 21 nt, Artificial Sequence
  Description of Artificial Sequence: Synthetic oligonucleotide
gaauggguggcgguaauuggu

SEQ ID NO: 2499 - RNA, 23 nt, Artificial Sequence
  Description of Artificial Sequence: Synthetic oligonucleotide
accaauuaccgccacccauucca

SEQ ID NO: 2500 - RNA, 21 nt, Artificial Sequence
  Description of Artificial Sequence: Synthetic oligonucleotide
aauggguggcgguaauuggug

SEQ ID NO: 2501 - RNA, 23 nt, Artificial Sequence
  Description of Artificial Sequence: Synthetic oligonucleotide
caccaauuaccgccacccauucc

SEQ ID NO: 2502 - RNA, 21 nt, Artificial Sequence
  Description of Artificial Sequence: Synthetic oligonucleotide
auuggaauggguggcgguaau

SEQ ID NO: 2503 - RNA, 23 nt, Artificial Sequence
  Description of Artificial Sequence: Synthetic oligonucleotide
auuaccgccacccauuccaauuc

SEQ ID NO: 2504 - RNA, 21 nt, Artificial Sequence
  Description of Artificial Sequence: Synthetic oligonucleotide
aauuggaauggguggcgguaa

SEQ ID NO: 2505 - RNA, 23 nt, Artificial Sequence
  Description of Artificial Sequence: Synthetic oligonucleotide
uuaccgccacccauuccaauucu

SEQ ID NO: 2506 - RNA, 21 nt, Artificial Sequence
  Description of Artificial Sequence: Synthetic oligonucleotide
uccggaauguugcugaaacag

SEQ ID NO: 2507 - RNA, 23 nt, Artificial Sequence
  Description of Artificial Sequence: Synthetic oligonucleotide
cuguuucagcaacauuccggagc

SEQ ID NO: 2508 - RNA, 21 nt, Artificial Sequence
  Description of Artificial Sequence: Synthetic oligonucleotide
ccggaauguugcugaaacaga

SEQ ID NO: 2509 - RNA, 23 nt, Artificial Sequence
  Description of Artificial Sequence: Synthetic oligonucleotide
ucuguuucagcaacauuccggag

SEQ ID NO: 2510 - RNA, 21 nt, Artificial Sequence
  Description of Artificial Sequence: Synthetic oligonucleotide
augcuccggaauguugcugaa

SEQ ID NO: 2511 - RNA, 23 nt, Artificial Sequence
  Description of Artificial Sequence: Synthetic oligonucleotide
uucagcaacauuccggagcaucc

SEQ ID NO: 2512 - RNA, 21 nt, Artificial Sequence
  Description of Artificial Sequence: Synthetic oligonucleotide
gaugcuccggaauguugcuga

SEQ ID NO: 2513 - RNA, 23 nt, Artificial Sequence
  Description of Artificial Sequence: Synthetic oligonucleotide
ucagcaacauuccggagcauccu

SEQ ID NO: 2514 - RNA, 21 nt, Artificial Sequence
  Description of Artificial Sequence: Synthetic oligonucleotide
uguccucgagauacuaaagga

SEQ ID NO: 2515 - RNA, 23 nt, Artificial Sequence
  Description of Artificial Sequence: Synthetic oligonucleotide
uccuuuaguaucucgaggacauc

SEQ ID NO: 2516 - RNA, 21 nt, Artificial Sequence
  Description of Artificial Sequence: Synthetic oligonucleotide
guccucgagauacuaaaggaa

SEQ ID NO: 2517 - RNA, 23 nt, Artificial Sequence
  Description of Artificial Sequence: Synthetic oligonucleotide
uuccuuuaguaucucgaggacau

SEQ ID NO: 2518 - RNA, 21 nt, Artificial Sequence
  Description of Artificial Sequence: Synthetic oligonucleotide
aagauguccucgagauacuaa

SEQ ID NO: 2519 - RNA, 23 nt, Artificial Sequence
  Description of Artificial Sequence: Synthetic oligonucleotide
uuaguaucucgaggacaucuuga

SEQ ID NO: 2520 - RNA, 21 nt, Artificial Sequence
  Description of Artificial Sequence: Synthetic oligonucleotide
caagauguccucgagauacua

SEQ ID NO: 2521 - RNA, 23 nt, Artificial Sequence
  Description of Artificial Sequence: Synthetic oligonucleotide
uaguaucucgaggacaucuugaa

SEQ ID NO: 2522 - RNA, 21 nt, Artificial Sequence
  Description of Artificial Sequence: Synthetic oligonucleotide
acaacaugcuaaaucaguacu

SEQ ID NO: 2523 - RNA, 23 nt, Artificial Sequence
  Description of Artificial Sequence: Synthetic oligonucleotide
aguacugauuuagcauguuguuc

SEQ ID NO: 2524 - RNA, 21 nt, Artificial Sequence
  Description of Artificial Sequence: Synthetic oligonucleotide
caacaugcuaaaucaguacuu

SEQ ID NO: 2525 - RNA, 23 nt, Artificial Sequence
  Description of Artificial Sequence: Synthetic oligonucleotide
aaguacugauuuagcauguuguu

SEQ ID NO: 2526 - RNA, 21 nt, Artificial Sequence
  Description of Artificial Sequence: Synthetic oligonucleotide
augaacaacaugcuaaaucag

SEQ ID NO: 2527 - RNA, 23 nt, Artificial Sequence
  Description of Artificial Sequence: Synthetic oligonucleotide
cugauuuagcauguuguucauaa

SEQ ID NO: 2528 - RNA, 21 nt, Artificial Sequence
  Description of Artificial Sequence: Synthetic oligonucleotide
uaugaacaacaugcuaaauca

SEQ ID NO: 2529 - RNA, 23 nt, Artificial Sequence
  Description of Artificial Sequence: Synthetic oligonucleotide
ugauuuagcauguuguucauaau

SEQ ID NO: 2530 - RNA, 21 nt, Artificial Sequence
  Description of Artificial Sequence: Synthetic oligonucleotide
gccaaggcuguguuugugggg

SEQ ID NO: 2531 - RNA, 23 nt, Artificial Sequence
  Description of Artificial Sequence: Synthetic oligonucleotide
ccccacaaacacagccuuggcgc

SEQ ID NO: 2532 - RNA, 21 nt, Artificial Sequence
  Description of Artificial Sequence: Synthetic oligonucleotide
ccaaggcuguguuugugggga

SEQ ID NO: 2533 - RNA, 23 nt, Artificial Sequence
  Description of Artificial Sequence: Synthetic oligonucleotide
uccccacaaacacagccuuggcg

SEQ ID NO: 2534 - RNA, 21 nt, Artificial Sequence
  Description of Artificial Sequence: Synthetic oligonucleotide
uggcgccaaggcuguguuugu

SEQ ID NO: 2535 - RNA, 23 nt, Artificial Sequence
  Description of Artificial Sequence: Synthetic oligonucleotide
acaaacacagccuuggcgccaag

SEQ ID NO: 2536 - RNA, 21 nt, Artificial Sequence
  Description of Artificial Sequence: Synthetic oligonucleotide
uuggcgccaaggcuguguuug

SEQ ID NO: 2537 - RNA, 23 nt, Artificial Sequence
  Description of Artificial Sequence: Synthetic oligonucleotide
caaacacagccuuggcgccaaga

SEQ ID NO: 2538 - RNA, 21 nt, Artificial Sequence
  Description of Artificial Sequence: Synthetic oligonucleotide
ugaaagcucuggcucuuggcg

SEQ ID NO: 2539 - RNA, 23 nt, Artificial Sequence
  Description of Artificial Sequence: Synthetic oligonucleotide
cgccaagagccagagcuuucaga

SEQ ID NO: 2540 - RNA, 21 nt, Artificial Sequence
  Description of Artificial Sequence: Synthetic oligonucleotide
gaaagcucuggcucuuggcgc

SEQ ID NO: 2541 - RNA, 23 nt, Artificial Sequence
  Description of Artificial Sequence: Synthetic oligonucleotide
gcgccaagagccagagcuuucag

SEQ ID NO: 2542 - RNA, 21 nt, Artificial Sequence
  Description of Artificial Sequence: Synthetic oligonucleotide
guucugaaagcucuggcucuu

SEQ ID NO: 2543 - RNA, 23 nt, Artificial Sequence
  Description of Artificial Sequence: Synthetic oligonucleotide
aagagccagagcuuucagaacau

SEQ ID NO: 2544 - RNA, 21 nt, Artificial Sequence
  Description of Artificial Sequence: Synthetic oligonucleotide
uguucugaaagcucuggcucu

SEQ ID NO: 2545 - RNA, 23 nt, Artificial Sequence
  Description of Artificial Sequence: Synthetic oligonucleotide
agagccagagcuuucagaacauc

SEQ ID NO: 2546 - RNA, 21 nt, Artificial Sequence
  Description of Artificial Sequence: Synthetic oligonucleotide
cagccacuauugauguucugc

SEQ ID NO: 2547 - RNA, 23 nt, Artificial Sequence
  Description of Artificial Sequence: Synthetic oligonucleotide
gcagaacaucaauaguggcuggc

SEQ ID NO: 2548 - RNA, 21 nt, Artificial Sequence
  Description of Artificial Sequence: Synthetic oligonucleotide
agccacuauugauguucugcc

SEQ ID NO: 2549 - RNA, 23 nt, Artificial Sequence
  Description of Artificial Sequence: Synthetic oligonucleotide
ggcagaacaucaauaguggcugg

SEQ ID NO: 2550 - RNA, 21 nt, Artificial Sequence
  Description of Artificial Sequence: Synthetic oligonucleotide
gugccagccacuauugauguu

SEQ ID NO: 2551 - RNA, 23 nt, Artificial Sequence
  Description of Artificial Sequence: Synthetic oligonucleotide
aacaucaauaguggcuggcaccc

SEQ ID NO: 2552 - RNA, 21 nt, Artificial Sequence
  Description of Artificial Sequence: Synthetic oligonucleotide
ggugccagccacuauugaugu

SEQ ID NO: 2553 - RNA, 23 nt, Artificial Sequence
  Description of Artificial Sequence: Synthetic oligonucleotide
acaucaauaguggcuggcacccc

SEQ ID NO: 2554 - RNA, 21 nt, Artificial Sequence
  Description of Artificial Sequence: Synthetic oligonucleotide
acaaggaccgagaagucacca

SEQ ID NO: 2555 - RNA, 23 nt, Artificial Sequence
  Description of Artificial Sequence: Synthetic oligonucleotide
uggugacuucucgguccuuguag

SEQ ID NO: 2556 - RNA, 21 nt, Artificial Sequence
  Description of Artificial Sequence: Synthetic oligonucleotide
caaggaccgagaagucaccaa

SEQ ID NO: 2557 - RNA, 23 nt, Artificial Sequence
  Description of Artificial Sequence: Synthetic oligonucleotide
uuggugacuucucgguccuugua

SEQ ID NO: 2558 - RNA, 21 nt, Artificial Sequence
  Description of Artificial Sequence: Synthetic oligonucleotide
aucuacaaggaccgagaaguc

SEQ ID NO: 2559 - RNA, 23 nt, Artificial Sequence
  Description of Artificial Sequence: Synthetic oligonucleotide
gacuucucgguccuuguagauau

SEQ ID NO: 2560 - RNA, 21 nt, Artificial Sequence
  Description of Artificial Sequence: Synthetic oligonucleotide
uaucuacaaggaccgagaagu

SEQ ID NO: 2561 - RNA, 23 nt, Artificial Sequence
  Description of Artificial Sequence: Synthetic oligonucleotide
acuucucgguccuuguagauaua

SEQ ID NO: 2562 - RNA, 21 nt, Artificial Sequence
  Description of Artificial Sequence: Synthetic oligonucleotide
cagaaugugaaagucaucgac

SEQ ID NO: 2563 - RNA, 23 nt, Artificial Sequence
  Description of Artificial Sequence: Synthetic oligonucleotide
gucgaugacuuucacauucuggc

SEQ ID NO: 2564 - RNA, 21 nt, Artificial Sequence
  Description of Artificial Sequence: Synthetic oligonucleotide
agaaugugaaagucaucgaca

SEQ ID NO: 2565 - RNA, 23 nt, Artificial Sequence
  Description of Artificial Sequence: Synthetic oligonucleotide
ugucgaugacuuucacauucugg

SEQ ID NO: 2566 - RNA, 21 nt, Artificial Sequence
  Description of Artificial Sequence: Synthetic oligonucleotide
gugccagaaugugaaagucau

SEQ ID NO: 2567 - RNA, 23 nt, Artificial Sequence
  Description of Artificial Sequence: Synthetic oligonucleotide
augacuuucacauucuggcaccc

SEQ ID NO: 2568 - RNA, 21 nt, Artificial Sequence
  Description of Artificial Sequence: Synthetic oligonucleotide
ggugccagaaugugaaaguca

SEQ ID NO: 2569 - RNA, 23 nt, Artificial Sequence
  Description of Artificial Sequence: Synthetic oligonucleotide
ugacuuucacauucuggcaccca

SEQ ID NO: 2570 - RNA, 21 nt, Artificial Sequence
  Description of Artificial Sequence: Synthetic oligonucleotide
agauguccucgagauacuaaa

SEQ ID NO: 2571 - RNA, 23 nt, Artificial Sequence
  Description of Artificial Sequence: Synthetic oligonucleotide
uuuaguaucucgaggacaucuug

SEQ ID NO: 2572 - RNA, 21 nt, Artificial Sequence
  Description of Artificial Sequence: Synthetic oligonucleotide
gauguccucgagauacuaaag

SEQ ID NO: 2573 - RNA, 23 nt, Artificial Sequence
  Description of Artificial Sequence: Synthetic oligonucleotide
cuuuaguaucucgaggacaucuu

SEQ ID NO: 2574 - RNA, 21 nt, Artificial Sequence
  Description of Artificial Sequence: Synthetic oligonucleotide
uucaagauguccucgagauac

SEQ ID NO: 2575 - RNA, 23 nt, Artificial Sequence
  Description of Artificial Sequence: Synthetic oligonucleotide
guaucucgaggacaucuugaaca

SEQ ID NO: 2576 - RNA, 21 nt, Artificial Sequence
  Description of Artificial Sequence: Synthetic oligonucleotide
guucaagauguccucgagaua

SEQ ID NO: 2577 - RNA, 23 nt, Artificial Sequence
  Description of Artificial Sequence: Synthetic oligonucleotide
uaucucgaggacaucuugaacac

SEQ ID NO: 2578 - RNA, 21 nt, Artificial Sequence
  Description of Artificial Sequence: Synthetic oligonucleotide
guggacuugcugcauaugugg

SEQ ID NO: 2579 - RNA, 23 nt, Artificial Sequence
  Description of Artificial Sequence: Synthetic oligonucleotide
ccacauaugcagcaaguccacug

SEQ ID NO: 2580 - RNA, 21 nt, Artificial Sequence
  Description of Artificial Sequence: Synthetic oligonucleotide
uggacuugcugcauauguggc

SEQ ID NO: 2581 - RNA, 23 nt, Artificial Sequence
  Description of Artificial Sequence: Synthetic oligonucleotide
gccacauaugcagcaaguccacu

SEQ ID NO: 2582 - RNA, 21 nt, Artificial Sequence
  Description of Artificial Sequence: Synthetic oligonucleotide
gacaguggacuugcugcauau

SEQ ID NO: 2583 - RNA, 23 nt, Artificial Sequence
  Description of Artificial Sequence: Synthetic oligonucleotide
auaugcagcaaguccacugucgu

SEQ ID NO: 2584 - RNA, 21 nt, Artificial Sequence
  Description of Artificial Sequence: Synthetic oligonucleotide
cgacaguggacuugcugcaua

SEQ ID NO: 2585 - RNA, 23 nt, Artificial Sequence
  Description of Artificial Sequence: Synthetic oligonucleotide
uaugcagcaaguccacugucguc

SEQ ID NO: 2586 - RNA, 21 nt, Artificial Sequence
  Description of Artificial Sequence: Synthetic oligonucleotide
aaccaguacuuuaucauuuuc

SEQ ID NO: 2587 - RNA, 23 nt, Artificial Sequence
  Description of Artificial Sequence: Synthetic oligonucleotide
gaaaaugauaaaguacugguuuc

SEQ ID NO: 2588 - RNA, 21 nt, Artificial Sequence
  Description of Artificial Sequence: Synthetic oligonucleotide
accaguacuuuaucauuuucu

SEQ ID NO: 2589 - RNA, 23 nt, Artificial Sequence
  Description of Artificial Sequence: Synthetic oligonucleotide
agaaaaugauaaaguacugguuu

SEQ ID NO: 2590 - RNA, 21 nt, Artificial Sequence
  Description of Artificial Sequence: Synthetic oligonucleotide
uugaaaccaguacuuuaucau

SEQ ID NO: 2591 - RNA, 23 nt, Artificial Sequence
  Description of Artificial Sequence: Synthetic oligonucleotide
augauaaaguacugguuucaaaa

SEQ ID NO: 2592 - RNA, 21 nt, Artificial Sequence
  Description of Artificial Sequence: Synthetic oligonucleotide
uuugaaaccaguacuuuauca

SEQ ID NO: 2593 - RNA, 23 nt, Artificial Sequence
  Description of Artificial Sequence: Synthetic oligonucleotide
ugauaaaguacugguuucaaaau

SEQ ID NO: 2594 - RNA, 21 nt, Artificial Sequence
  Description of Artificial Sequence: Synthetic oligonucleotide
cgagaagucaccaagaagcua

SEQ ID NO: 2595 - RNA, 23 nt, Artificial Sequence
  Description of Artificial Sequence: Synthetic oligonucleotide
uagcuucuuggugacuucucggu

SEQ ID NO: 2596 - RNA, 21 nt, Artificial Sequence
  Description of Artificial Sequence: Synthetic oligonucleotide
gagaagucaccaagaagcuag

SEQ ID NO: 2597 - RNA, 23 nt, Artificial Sequence
  Description of Artificial Sequence: Synthetic oligonucleotide
cuagcuucuuggugacuucucgg

SEQ ID NO: 2598 - RNA, 21 nt, Artificial Sequence
  Description of Artificial Sequence: Synthetic oligonucleotide
ggaccgagaagucaccaagaa

SEQ ID NO: 2599 - RNA, 23 nt, Artificial Sequence
  Description of Artificial Sequence: Synthetic oligonucleotide
uucuuggugacuucucgguccuu

SEQ ID NO: 2600 - RNA, 21 nt, Artificial Sequence
  Description of Artificial Sequence: Synthetic oligonucleotide
aggaccgagaagucaccaaga

SEQ ID NO: 2601 - RNA, 23 nt, Artificial Sequence
  Description of Artificial Sequence: Synthetic oligonucleotide
ucuuggugacuucucgguccuug

SEQ ID NO: 2602 - RNA, 21 nt, Artificial Sequence
  Description of Artificial Sequence: Synthetic oligonucleotide
ucaaaguguugguaaugccug

SEQ ID NO: 2603 - RNA, 23 nt, Artificial Sequence
  Description of Artificial Sequence: Synthetic oligonucleotide
caggcauuaccaacacuuugaac

SEQ ID NO: 2604 - RNA, 21 nt, Artificial Sequence
  Description of Artificial Sequence: Synthetic oligonucleotide
caaaguguugguaaugccuga

SEQ ID NO: 2605 - RNA, 23 nt, Artificial Sequence
  Description of Artificial Sequence: Synthetic oligonucleotide
ucaggcauuaccaacacuuugaa

SEQ ID NO: 2606 - RNA, 21 nt, Artificial Sequence
  Description of Artificial Sequence: Synthetic oligonucleotide
agguucaaaguguugguaaug

SEQ ID NO: 2607 - RNA, 23 nt, Artificial Sequence
  Description of Artificial Sequence: Synthetic oligonucleotide
cauuaccaacacuuugaaccuga

SEQ ID NO: 2608 - RNA, 21 nt, Artificial Sequence
  Description of Artificial Sequence: Synthetic oligonucleotide
cagguucaaaguguugguaau

SEQ ID NO: 2609 - RNA, 23 nt, Artificial Sequence
  Description of Artificial Sequence: Synthetic oligonucleotide
auuaccaacacuuugaaccugag

SEQ ID NO: 2610 - RNA, 21 nt, Artificial Sequence
  Description of Artificial Sequence: Synthetic oligonucleotide
uauuacuugacaaagagacac

SEQ ID NO: 2611 - RNA, 23 nt, Artificial Sequence
  Description of Artificial Sequence: Synthetic oligonucleotide
gugucucuuugucaaguaauaca

SEQ ID NO: 2612 - RNA, 21 nt, Artificial Sequence
  Description of Artificial Sequence: Synthetic oligonucleotide
auuacuugacaaagagacacu

SEQ ID NO: 2613 - RNA, 23 nt, Artificial Sequence
  Description of Artificial Sequence: Synthetic oligonucleotide
agugucucuuugucaaguaauac

SEQ ID NO: 2614 - RNA, 21 nt, Artificial Sequence
  Description of Artificial Sequence: Synthetic oligonucleotide
cauguauuacuugacaaagag

SEQ ID NO: 2615 - RNA, 23 nt, Artificial Sequence
  Description of Artificial Sequence: Synthetic oligonucleotide
cucuuugucaaguaauacaugcu

SEQ ID NO: 2616 - RNA, 21 nt, Artificial Sequence
  Description of Artificial Sequence: Synthetic oligonucleotide
gcauguauuacuugacaaaga

SEQ ID NO: 2617 - RNA, 23 nt, Artificial Sequence
  Description of Artificial Sequence: Synthetic oligonucleotide
ucuuugucaaguaauacaugcug

SEQ ID NO: 2618 - RNA, 21 nt, Artificial Sequence
  Description of Artificial Sequence: Synthetic oligonucleotide
aaagucaucgacaagacauug

SEQ ID NO: 2619 - RNA, 23 nt, Artificial Sequence
  Description of Artificial Sequence: Synthetic oligonucleotide
caaugucuugucgaugacuuuca

SEQ ID NO: 2620 - RNA, 21 nt, Artificial Sequence
  Description of Artificial Sequence: Synthetic oligonucleotide
aagucaucgacaagacauugg

SEQ ID NO: 2621 - RNA, 23 nt, Artificial Sequence
  Description of Artificial Sequence: Synthetic oligonucleotide
ccaaugucuugucgaugacuuuc

SEQ ID NO: 2622 - RNA, 21 nt, Artificial Sequence
  Description of Artificial Sequence: Synthetic oligonucleotide
ugugaaagucaucgacaagac

SEQ ID NO: 2623 - RNA, 23 nt, Artificial Sequence
  Description of Artificial Sequence: Synthetic oligonucleotide
gucuugucgaugacuuucacauu

SEQ ID NO: 2624 - RNA, 21 nt, Artificial Sequence
  Description of Artificial Sequence: Synthetic oligonucleotide
augugaaagucaucgacaaga

SEQ ID NO: 2625 - RNA, 23 nt, Artificial Sequence
  Description of Artificial Sequence: Synthetic oligonucleotide
ucuugucgaugacuuucacauuc

SEQ ID NO: 2626 - RNA, 21 nt, Artificial Sequence
  Description of Artificial Sequence: Synthetic oligonucleotide
auauguggcuaaagcaauaga

SEQ ID NO: 2627 - RNA, 23 nt, Artificial Sequence
  Description of Artificial Sequence: Synthetic oligonucleotide
ucuauugcuuuagccacauaugc

SEQ ID NO: 2628 - RNA, 21 nt, Artificial Sequence
  Description of Artificial Sequence: Synthetic oligonucleotide
uauguggcuaaagcaauagac

SEQ ID NO: 2629 - RNA, 23 nt, Artificial Sequence
  Description of Artificial Sequence: Synthetic oligonucleotide
gucuauugcuuuagccacauaug

SEQ ID NO: 2630 - RNA, 21 nt, Artificial Sequence
  Description of Artificial Sequence: Synthetic oligonucleotide
cugcauauguggcuaaagcaa

SEQ ID NO: 2631 - RNA, 23 nt, Artificial Sequence
  Description of Artificial Sequence: Synthetic oligonucleotide
uugcuuuagccacauaugcagca

SEQ ID NO: 2632 - RNA, 21 nt, Artificial Sequence
  Description of Artificial Sequence: Synthetic oligonucleotide
gcugcauauguggcuaaagca

SEQ ID NO: 2633 - RNA, 23 nt, Artificial Sequence
  Description of Artificial Sequence: Synthetic oligonucleotide
ugcuuuagccacauaugcagcaa

SEQ ID NO: 2634 - RNA, 21 nt, Artificial Sequence
  Description of Artificial Sequence: Synthetic oligonucleotide
agacgacaguggacuugcugc

SEQ ID NO: 2635 - RNA, 23 nt, Artificial Sequence
  Description of Artificial Sequence: Synthetic oligonucleotide
gcagcaaguccacugucgucucc

SEQ ID NO: 2636 - RNA, 21 nt, Artificial Sequence
  Description of Artificial Sequence: Synthetic oligonucleotide
gacgacaguggacuugcugca

SEQ ID NO: 2637 - RNA, 23 nt, Artificial Sequence
  Description of Artificial Sequence: Synthetic oligonucleotide
ugcagcaaguccacugucgucuc

SEQ ID NO: 2638 - RNA, 21 nt, Artificial Sequence
  Description of Artificial Sequence: Synthetic oligonucleotide
uuggagacgacaguggacuug

SEQ ID NO: 2639 - RNA, 23 nt, Artificial Sequence
  Description of Artificial Sequence: Synthetic oligonucleotide
caaguccacugucgucuccaaaa

SEQ ID NO: 2640 - RNA, 21 nt, Artificial Sequence
  Description of Artificial Sequence: Synthetic oligonucleotide
uuuggagacgacaguggacuu

SEQ ID NO: 2641 - RNA, 23 nt, Artificial Sequence
  Description of Artificial Sequence: Synthetic oligonucleotide
aaguccacugucgucuccaaaau

SEQ ID NO: 2642 - RNA, 21 nt, Artificial Sequence
  Description of Artificial Sequence: Synthetic oligonucleotide
ggccaccuccucaauugaaga

SEQ ID NO: 2643 - RNA, 23 nt, Artificial Sequence
  Description of Artificial Sequence: Synthetic oligonucleotide
ucuucaauugaggagguggccca

SEQ ID NO: 2644 - RNA, 21 nt, Artificial Sequence
  Description of Artificial Sequence: Synthetic oligonucleotide
gccaccuccucaauugaagaa

SEQ ID NO: 2645 - RNA, 23 nt, Artificial Sequence
  Description of Artificial Sequence: Synthetic oligonucleotide
uucuucaauugaggagguggccc

SEQ ID NO: 2646 - RNA, 21 nt, Artificial Sequence
  Description of Artificial Sequence: Synthetic oligonucleotide
ccugggccaccuccucaauug

SEQ ID NO: 2647 - RNA, 23 nt, Artificial Sequence
  Description of Artificial Sequence: Synthetic oligonucleotide
caauugaggagguggcccaggaa

SEQ ID NO: 2648 - RNA, 21 nt, Artificial Sequence
  Description of Artificial Sequence: Synthetic oligonucleotide
uccugggccaccuccucaauu

SEQ ID NO: 2649 - RNA, 23 nt, Artificial Sequence
  Description of Artificial Sequence: Synthetic oligonucleotide
aauugaggagguggcccaggaac

SEQ ID NO: 2650 - RNA, 21 nt, Artificial Sequence
  Description of Artificial Sequence: Synthetic oligonucleotide
uguauguuacuucuuagagag

SEQ ID NO: 2651 - RNA, 23 nt, Artificial Sequence
  Description of Artificial Sequence: Synthetic oligonucleotide
cucucuaagaaguaacauacauc

SEQ ID NO: 2652 - RNA, 21 nt, Artificial Sequence
  Description of Artificial Sequence: Synthetic oligonucleotide
guauguuacuucuuagagaga

SEQ ID NO: 2653 - RNA, 23 nt, Artificial Sequence
  Description of Artificial Sequence: Synthetic oligonucleotide
ucucucuaagaaguaacauacau

SEQ ID NO: 2654 - RNA, 21 nt, Artificial Sequence
  Description of Artificial Sequence: Synthetic oligonucleotide
aggauguauguuacuucuuag

SEQ ID NO: 2655 - RNA, 23 nt, Artificial Sequence
  Description of Artificial Sequence: Synthetic oligonucleotide
cuaagaaguaacauacauccuaa

SEQ ID NO: 2656 - RNA, 21 nt, Artificial Sequence
  Description of Artificial Sequence: Synthetic oligonucleotide
uaggauguauguuacuucuua

SEQ ID NO: 2657 - RNA, 23 nt, Artificial Sequence
  Description of Artificial Sequence: Synthetic oligonucleotide
uaagaaguaacauacauccuaaa

SEQ ID NO: 2658 - RNA, 21 nt, Artificial Sequence
  Description of Artificial Sequence: Synthetic oligonucleotide
aaauguuuuaggauguauguu

SEQ ID NO: 2659 - RNA, 23 nt, Artificial Sequence
  Description of Artificial Sequence: Synthetic oligonucleotide
aacauacauccuaaaacauuugg

SEQ ID NO: 2660 - RNA, 21 nt, Artificial Sequence
  Description of Artificial Sequence: Synthetic oligonucleotide
aauguuuuaggauguauguua

SEQ ID NO: 2661 - RNA, 23 nt, Artificial Sequence
  Description of Artificial Sequence: Synthetic oligonucleotide
uaacauacauccuaaaacauuug

SEQ ID NO: 2662 - RNA, 21 nt, Artificial Sequence
  Description of Artificial Sequence: Synthetic oligonucleotide
auccaaauguuuuaggaugua

SEQ ID NO: 2663 - RNA, 23 nt, Artificial Sequence
  Description of Artificial Sequence: Synthetic oligonucleotide
uacauccuaaaacauuuggauau

SEQ ID NO: 2664 - RNA, 21 nt, Artificial Sequence
  Description of Artificial Sequence: Synthetic oligonucleotide
uauccaaauguuuuaggaugu

SEQ ID NO: 2665 - RNA, 23 nt, Artificial Sequence
  Description of Artificial Sequence: Synthetic oligonucleotide
acauccuaaaacauuuggauaua

SEQ ID NO: 2666 - RNA, 21 nt, Artificial Sequence
  Description of Artificial Sequence: Synthetic oligonucleotide
auggguggcgguaauugguga

SEQ ID NO: 2667 - RNA, 23 nt, Artificial Sequence
  Description of Artificial Sequence: Synthetic oligonucleotide
ucaccaauuaccgccacccauuc

SEQ ID NO: 2668 - RNA, 21 nt, Artificial Sequence
  Description of Artificial Sequence: Synthetic oligonucleotide
uggguggcgguaauuggugau

SEQ ID NO: 2669 - RNA, 23 nt, Artificial Sequence
  Description of Artificial Sequence: Synthetic oligonucleotide
aucaccaauuaccgccacccauu

SEQ ID NO: 2670 - RNA, 21 nt, Artificial Sequence
  Description of Artificial Sequence: Synthetic oligonucleotide
uggaauggguggcgguaauug

SEQ ID NO: 2671 - RNA, 23 nt, Artificial Sequence
  Description of Artificial Sequence: Synthetic oligonucleotide
caauuaccgccacccauuccaau

SEQ ID NO: 2672 - RNA, 21 nt, Artificial Sequence
  Description of Artificial Sequence: Synthetic oligonucleotide
uuggaauggguggcgguaauu

SEQ ID NO: 2673 - RNA, 23 nt, Artificial Sequence
  Description of Artificial Sequence: Synthetic oligonucleotide
aauuaccgccacccauuccaauu

SEQ ID NO: 2674 - RNA, 21 nt, Artificial Sequence
  Description of Artificial Sequence: Synthetic oligonucleotide
uucaaaguguugguaaugccu

SEQ ID NO: 2675 - RNA, 23 nt, Artificial Sequence
  Description of Artificial Sequence: Synthetic oligonucleotide
aggcauuaccaacacuuugaacc

SEQ ID NO: 2676 - RNA, 21 nt, Artificial Sequence
  Description of Artificial Sequence: Synthetic oligonucleotide
ucaaaguguugguaaugccug

SEQ ID NO: 2677 - RNA, 23 nt, Artificial Sequence
  Description of Artificial Sequence: Synthetic oligonucleotide
caggcauuaccaacacuuugaac

SEQ ID NO: 2678 - RNA, 21 nt, Artificial Sequence
  Description of Artificial Sequence: Synthetic oligonucleotide
cagguucaaaguguugguaau

SEQ ID NO: 2679 - RNA, 23 nt, Artificial Sequence
  Description of Artificial Sequence: Synthetic oligonucleotide
auuaccaacacuuugaaccugag

SEQ ID NO: 2680 - RNA, 21 nt, Artificial Sequence
  Description of Artificial Sequence: Synthetic oligonucleotide
ucagguucaaaguguugguaa

SEQ ID NO: 2681 - RNA, 23 nt, Artificial Sequence
  Description of Artificial Sequence: Synthetic oligonucleotide
uuaccaacacuuugaaccugagc

SEQ ID NO: 2682 - RNA, 21 nt, Artificial Sequence
  Description of Artificial Sequence: Synthetic oligonucleotide
ccaccuccucaauugaagaag

SEQ ID NO: 2683 - RNA, 23 nt, Artificial Sequence
  Description of Artificial Sequence: Synthetic oligonucleotide
cuucuucaauugaggagguggcc

SEQ ID NO: 2684 - RNA, 21 nt, Artificial Sequence
  Description of Artificial Sequence: Synthetic oligonucleotide
caccuccucaauugaagaagu

SEQ ID NO: 2685 - RNA, 23 nt, Artificial Sequence
  Description of Artificial Sequence: Synthetic oligonucleotide
acuucuucaauugaggagguggc

SEQ ID NO: 2686 - RNA, 21 nt, Artificial Sequence
  Description of Artificial Sequence: Synthetic oligonucleotide
ugggccaccuccucaauugaa

SEQ ID NO: 2687 - RNA, 23 nt, Artificial Sequence
  Description of Artificial Sequence: Synthetic oligonucleotide
uucaauugaggagguggcccagg

SEQ ID NO: 2688 - RNA, 21 nt, Artificial Sequence
  Description of Artificial Sequence: Synthetic oligonucleotide
cugggccaccuccucaauuga

SEQ ID NO: 2689 - RNA, 23 nt, Artificial Sequence
  Description of Artificial Sequence: Synthetic oligonucleotide
ucaauugaggagguggcccagga

SEQ ID NO: 2690 - RNA, 21 nt, Artificial Sequence
  Description of Artificial Sequence: Synthetic oligonucleotide
gagugggugccagaaugugaa

SEQ ID NO: 2691 - RNA, 23 nt, Artificial Sequence
  Description of Artificial Sequence: Synthetic oligonucleotide
uucacauucuggcacccacucag

SEQ ID NO: 2692 - RNA, 21 nt, Artificial Sequence
  Description of Artificial Sequence: Synthetic oligonucleotide
agugggugccagaaugugaaa

SEQ ID NO: 2693 - RNA, 23 nt, Artificial Sequence
  Description of Artificial Sequence: Synthetic oligonucleotide
uuucacauucuggcacccacuca

SEQ ID NO: 2694 - RNA, 21 nt, Artificial Sequence
  Description of Artificial Sequence: Synthetic oligonucleotide
cucugagugggugccagaaug

SEQ ID NO: 2695 - RNA, 23 nt, Artificial Sequence
  Description of Artificial Sequence: Synthetic oligonucleotide
cauucuggcacccacucagagcc

SEQ ID NO: 2696 - RNA, 21 nt, Artificial Sequence
  Description of Artificial Sequence: Synthetic oligonucleotide
gcucugagugggugccagaau

SEQ ID NO: 2697 - RNA, 23 nt, Artificial Sequence
  Description of Artificial Sequence: Synthetic oligonucleotide
auucuggcacccacucagagcca

SEQ ID NO: 2698 - RNA, 21 nt, Artificial Sequence
  Description of Artificial Sequence: Synthetic oligonucleotide
gcacugauguucugaaagcuc

SEQ ID NO: 2699 - RNA, 23 nt, Artificial Sequence
  Description of Artificial Sequence: Synthetic oligonucleotide
gagcuuucagaacaucagugccu

SEQ ID NO: 2700 - RNA, 21 nt, Artificial Sequence
  Description of Artificial Sequence: Synthetic oligonucleotide
cacugauguucugaaagcucu

SEQ ID NO: 2701 - RNA, 23 nt, Artificial Sequence
  Description of Artificial Sequence: Synthetic oligonucleotide
agagcuuucagaacaucagugcc

SEQ ID NO: 2702 - RNA, 21 nt, Artificial Sequence
  Description of Artificial Sequence: Synthetic oligonucleotide
aaaggcacugauguucugaaa

SEQ ID NO: 2703 - RNA, 23 nt, Artificial Sequence
  Description of Artificial Sequence: Synthetic oligonucleotide
uuucagaacaucagugccuuucc

SEQ ID NO: 2704 - RNA, 21 nt, Artificial Sequence
  Description of Artificial Sequence: Synthetic oligonucleotide
gaaaggcacugauguucugaa

SEQ ID NO: 2705 - RNA, 23 nt, Artificial Sequence
  Description of Artificial Sequence: Synthetic oligonucleotide
uucagaacaucagugccuuuccg

SEQ ID NO: 2706 - RNA, 21 nt, Artificial Sequence
  Description of Artificial Sequence: Synthetic oligonucleotide
gggaagguggaagucuuccug

SEQ ID NO: 2707 - RNA, 23 nt, Artificial Sequence
  Description of Artificial Sequence: Synthetic oligonucleotide
caggaagacuuccaccuucccuu

SEQ ID NO: 2708 - RNA, 21 nt, Artificial Sequence
  Description of Artificial Sequence: Synthetic oligonucleotide
ggaagguggaagucuuccugg

SEQ ID NO: 2709 - RNA, 23 nt, Artificial Sequence
  Description of Artificial Sequence: Synthetic oligonucleotide
ccaggaagacuuccaccuucccu

SEQ ID NO: 2710 - RNA, 21 nt, Artificial Sequence
  Description of Artificial Sequence: Synthetic oligonucleotide
ggaagggaagguggaagucuu

SEQ ID NO: 2711 - RNA, 23 nt, Artificial Sequence
  Description of Artificial Sequence: Synthetic oligonucleotide
aagacuuccaccuucccuuccac

SEQ ID NO: 2712 - RNA, 21 nt, Artificial Sequence
  Description of Artificial Sequence: Synthetic oligonucleotide
uggaagggaagguggaagucu

SEQ ID NO: 2713 - RNA, 23 nt, Artificial Sequence
  Description of Artificial Sequence: Synthetic oligonucleotide
agacuuccaccuucccuuccaca

SEQ ID NO: 2714 - RNA, 21 nt, Artificial Sequence
  Description of Artificial Sequence: Synthetic oligonucleotide
ugcuaaaucaguacuuccaaa

SEQ ID NO: 2715 - RNA, 23 nt, Artificial Sequence
  Description of Artificial Sequence: Synthetic oligonucleotide
uuuggaaguacugauuuagcaug

SEQ ID NO: 2716 - RNA, 21 nt, Artificial Sequence
  Description of Artificial Sequence: Synthetic oligonucleotide
gcuaaaucaguacuuccaaag

SEQ ID NO: 2717 - RNA, 23 nt, Artificial Sequence
  Description of Artificial Sequence: Synthetic oligonucleotide
cuuuggaaguacugauuuagcau

SEQ ID NO: 2718 - RNA, 21 nt, Artificial Sequence
  Description of Artificial Sequence: Synthetic oligonucleotide
aacaugcuaaaucaguacuuc

SEQ ID NO: 2719 - RNA, 23 nt, Artificial Sequence
  Description of Artificial Sequence: Synthetic oligonucleotide
gaaguacugauuuagcauguugu

SEQ ID NO: 2720 - RNA, 21 nt, Artificial Sequence
  Description of Artificial Sequence: Synthetic oligonucleotide
caacaugcuaaaucaguacuu

SEQ ID NO: 2721 - RNA, 23 nt, Artificial Sequence
  Description of Artificial Sequence: Synthetic oligonucleotide
aaguacugauuuagcauguuguu

SEQ ID NO: 2722 - RNA, 21 nt, Artificial Sequence
  Description of Artificial Sequence: Synthetic oligonucleotide
ccacaacucaggaugaaaaau

SEQ ID NO: 2723 - RNA, 23 nt, Artificial Sequence
  Description of Artificial Sequence: Synthetic oligonucleotide
auuuuucauccugaguuguggcg

SEQ ID NO: 2724 - RNA, 21 nt, Artificial Sequence
  Description of Artificial Sequence: Synthetic oligonucleotide
cacaacucaggaugaaaaauu

SEQ ID NO: 2725 - RNA, 23 nt, Artificial Sequence
  Description of Artificial Sequence: Synthetic oligonucleotide
aauuuuucauccugaguuguggc

SEQ ID NO: 2726 - RNA, 21 nt, Artificial Sequence
  Description of Artificial Sequence: Synthetic oligonucleotide
gccgccacaacucaggaugaa

SEQ ID NO: 2727 - RNA, 23 nt, Artificial Sequence
  Description of Artificial Sequence: Synthetic oligonucleotide
uucauccugaguuguggcggcag

SEQ ID NO: 2728 - RNA, 21 nt, Artificial Sequence
  Description of Artificial Sequence: Synthetic oligonucleotide
ugccgccacaacucaggauga

SEQ ID NO: 2729 - RNA, 23 nt, Artificial Sequence
  Description of Artificial Sequence: Synthetic oligonucleotide
ucauccugaguuguggcggcagu

SEQ ID NO: 2730 - RNA, 21 nt, Artificial Sequence
  Description of Artificial Sequence: Synthetic oligonucleotide
gcaaccgucuggaugaugugc

SEQ ID NO: 2731 - RNA, 23 nt, Artificial Sequence
  Description of Artificial Sequence: Synthetic oligonucleotide
gcacaucauccagacgguugccc

SEQ ID NO: 2732 - RNA, 21 nt, Artificial Sequence
  Description of Artificial Sequence: Synthetic oligonucleotide
caaccgucuggaugaugugcg

SEQ ID NO: 2733 - RNA, 23 nt, Artificial Sequence
  Description of Artificial Sequence: Synthetic oligonucleotide
cgcacaucauccagacgguugcc

SEQ ID NO: 2734 - RNA, 21 nt, Artificial Sequence
  Description of Artificial Sequence: Synthetic oligonucleotide
cugggcaaccgucuggaugau

SEQ ID NO: 2735 - RNA, 23 nt, Artificial Sequence
  Description of Artificial Sequence: Synthetic oligonucleotide
aucauccagacgguugcccaggu

SEQ ID NO: 2736 - RNA, 21 nt, Artificial Sequence
  Description of Artificial Sequence: Synthetic oligonucleotide
ccugggcaaccgucuggauga

SEQ ID NO: 2737 - RNA, 23 nt, Artificial Sequence
  Description of Artificial Sequence: Synthetic oligonucleotide
ucauccagacgguugcccaggua

SEQ ID NO: 2738 - RNA, 21 nt, Artificial Sequence
  Description of Artificial Sequence: Synthetic oligonucleotide
gcaaaugaugaagaaacuuug

SEQ ID NO: 2739 - RNA, 23 nt, Artificial Sequence
  Description of Artificial Sequence: Synthetic oligonucleotide
caaaguuucuucaucauuugccc

SEQ ID NO: 2740 - RNA, 21 nt, Artificial Sequence
  Description of Artificial Sequence: Synthetic oligonucleotide
caaaugaugaagaaacuuugg

SEQ ID NO: 2741 - RNA, 23 nt, Artificial Sequence
  Description of Artificial Sequence: Synthetic oligonucleotide
ccaaaguuucuucaucauuugcc

SEQ ID NO: 2742 - RNA, 21 nt, Artificial Sequence
  Description of Artificial Sequence: Synthetic oligonucleotide
uggggcaaaugaugaagaaac

SEQ ID NO: 2743 - RNA, 23 nt, Artificial Sequence
  Description of Artificial Sequence: Synthetic oligonucleotide
guuucuucaucauuugccccaga

SEQ ID NO: 2744 - RNA, 21 nt, Artificial Sequence
  Description of Artificial Sequence: Synthetic oligonucleotide
cuggggcaaaugaugaagaaa

SEQ ID NO: 2745 - RNA, 23 nt, Artificial Sequence
  Description of Artificial Sequence: Synthetic oligonucleotide
uuucuucaucauuugccccagac

SEQ ID NO: 2746 - RNA, 21 nt, Artificial Sequence
  Description of Artificial Sequence: Synthetic oligonucleotide
ccaaggcuguguuugugggga

SEQ ID NO: 2747 - RNA, 23 nt, Artificial Sequence
  Description of Artificial Sequence: Synthetic oligonucleotide
uccccacaaacacagccuuggcg

SEQ ID NO: 2748 - RNA, 21 nt, Artificial Sequence
  Description of Artificial Sequence: Synthetic oligonucleotide
caaggcuguguuuguggggag

SEQ ID NO: 2749 - RNA, 23 nt, Artificial Sequence
  Description of Artificial Sequence: Synthetic oligonucleotide
cuccccacaaacacagccuuggc

SEQ ID NO: 2750 - RNA, 21 nt, Artificial Sequence
  Description of Artificial Sequence: Synthetic oligonucleotide
ggcgccaaggcuguguuugug

SEQ ID NO: 2751 - RNA, 23 nt, Artificial Sequence
  Description of Artificial Sequence: Synthetic oligonucleotide
cacaaacacagccuuggcgccaa

SEQ ID NO: 2752 - RNA, 21 nt, Artificial Sequence
  Description of Artificial Sequence: Synthetic oligonucleotide
uggcgccaaggcuguguuugu

SEQ ID NO: 2753 - RNA, 23 nt, Artificial Sequence
  Description of Artificial Sequence: Synthetic oligonucleotide
acaaacacagccuuggcgccaag

SEQ ID NO: 2754 - RNA, 21 nt, Artificial Sequence
  Description of Artificial Sequence: Synthetic oligonucleotide
acugccgccacaacucaggau

SEQ ID NO: 2755 - RNA, 23 nt, Artificial Sequence
  Description of Artificial Sequence: Synthetic oligonucleotide
auccugaguuguggcggcaguuu

SEQ ID NO: 2756 - RNA, 21 nt, Artificial Sequence
  Description of Artificial Sequence: Synthetic oligonucleotide
cugccgccacaacucaggaug

SEQ ID NO: 2757 - RNA, 23 nt, Artificial Sequence
  Description of Artificial Sequence: Synthetic oligonucleotide
cauccugaguuguggcggcaguu

SEQ ID NO: 2758 - RNA, 21 nt, Artificial Sequence
  Description of Artificial Sequence: Synthetic oligonucleotide
ucaaacugccgccacaacuca

SEQ ID NO: 2759 - RNA, 23 nt, Artificial Sequence
  Description of Artificial Sequence: Synthetic oligonucleotide
ugaguuguggcggcaguuugaau

SEQ ID NO: 2760 - RNA, 21 nt, Artificial Sequence
  Description of Artificial Sequence: Synthetic oligonucleotide
uucaaacugccgccacaacuc

SEQ ID NO: 2761 - RNA, 23 nt, Artificial Sequence
  Description of Artificial Sequence: Synthetic oligonucleotide
gaguuguggcggcaguuugaauc

SEQ ID NO: 2762 - RNA, 21 nt, Artificial Sequence
  Description of Artificial Sequence: Synthetic oligonucleotide
gggaagauaucaaauggcuga

SEQ ID NO: 2763 - RNA, 23 nt, Artificial Sequence
  Description of Artificial Sequence: Synthetic oligonucleotide
ucagccauuugauaucuucccag

SEQ ID NO: 2764 - RNA, 21 nt, Artificial Sequence
  Description of Artificial Sequence: Synthetic oligonucleotide
ggaagauaucaaauggcugag

SEQ ID NO: 2765 - RNA, 23 nt, Artificial Sequence
  Description of Artificial Sequence: Synthetic oligonucleotide
cucagccauuugauaucuuccca

SEQ ID NO: 2766 - RNA, 21 nt, Artificial Sequence
  Description of Artificial Sequence: Synthetic oligonucleotide
agcugggaagauaucaaaugg

SEQ ID NO: 2767 - RNA, 23 nt, Artificial Sequence
  Description of Artificial Sequence: Synthetic oligonucleotide
ccauuugauaucuucccagcuga

SEQ ID NO: 2768 - RNA, 21 nt, Artificial Sequence
  Description of Artificial Sequence: Synthetic oligonucleotide
cagcugggaagauaucaaaug

SEQ ID NO: 2769 - RNA, 23 nt, Artificial Sequence
  Description of Artificial Sequence: Synthetic oligonucleotide
cauuugauaucuucccagcugau

SEQ ID NO: 2770 - RNA, 21 nt, Artificial Sequence
  Description of Artificial Sequence: Synthetic oligonucleotide
aaucaguacuuccaaagucua

SEQ ID NO: 2771 - RNA, 23 nt, Artificial Sequence
  Description of Artificial Sequence: Synthetic oligonucleotide
uagacuuuggaaguacugauuua

SEQ ID NO: 2772 - RNA, 21 nt, Artificial Sequence
  Description of Artificial Sequence: Synthetic oligonucleotide
aucaguacuuccaaagucuau

SEQ ID NO: 2773 - RNA, 23 nt, Artificial Sequence
  Description of Artificial Sequence: Synthetic oligonucleotide
auagacuuuggaaguacugauuu

SEQ ID NO: 2774 - RNA, 21 nt, Artificial Sequence
  Description of Artificial Sequence: Synthetic oligonucleotide
gcuaaaucaguacuuccaaag

SEQ ID NO: 2775 - RNA, 23 nt, Artificial Sequence
  Description of Artificial Sequence: Synthetic oligonucleotide
cuuuggaaguacugauuuagcau

SEQ ID NO: 2776 - RNA, 21 nt, Artificial Sequence
  Description of Artificial Sequence: Synthetic oligonucleotide
ugcuaaaucaguacuuccaaa

SEQ ID NO: 2777 - RNA, 23 nt, Artificial Sequence
  Description of Artificial Sequence: Synthetic oligonucleotide
uuuggaaguacugauuuagcaug

SEQ ID NO: 2778 - RNA, 21 nt, Artificial Sequence
  Description of Artificial Sequence: Synthetic oligonucleotide
ucagcaugccaauaugugugg

SEQ ID NO: 2779 - RNA, 23 nt, Artificial Sequence
  Description of Artificial Sequence: Synthetic oligonucleotide
ccacacauauuggcaugcugacc

SEQ ID NO: 2780 - RNA, 21 nt, Artificial Sequence
  Description of Artificial Sequence: Synthetic oligonucleotide
cagcaugccaauauguguggg

SEQ ID NO: 2781 - RNA, 23 nt, Artificial Sequence
  Description of Artificial Sequence: Synthetic oligonucleotide
cccacacauauuggcaugcugac

SEQ ID NO: 2782 - RNA, 21 nt, Artificial Sequence
  Description of Artificial Sequence: Synthetic oligonucleotide
agggucagcaugccaauaugu

SEQ ID NO: 2783 - RNA, 23 nt, Artificial Sequence
  Description of Artificial Sequence: Synthetic oligonucleotide
acauauuggcaugcugacccucu

SEQ ID NO: 2784 - RNA, 21 nt, Artificial Sequence
  Description of Artificial Sequence: Synthetic oligonucleotide
gagggucagcaugccaauaug

SEQ ID NO: 2785 - RNA, 23 nt, Artificial Sequence
  Description of Artificial Sequence: Synthetic oligonucleotide
cauauuggcaugcugacccucug

SEQ ID NO: 2786 - RNA, 21 nt, Artificial Sequence
  Description of Artificial Sequence: Synthetic oligonucleotide
gcauauguggcuaaagcaaua

SEQ ID NO: 2787 - RNA, 23 nt, Artificial Sequence
  Description of Artificial Sequence: Synthetic oligonucleotide
uauugcuuuagccacauaugcag

SEQ ID NO: 2788 - RNA, 21 nt, Artificial Sequence
  Description of Artificial Sequence: Synthetic oligonucleotide
cauauguggcuaaagcaauag

SEQ ID NO: 2789 - RNA, 23 nt, Artificial Sequence
  Description of Artificial Sequence: Synthetic oligonucleotide
cuauugcuuuagccacauaugca

SEQ ID NO: 2790 - RNA, 21 nt, Artificial Sequence
  Description of Artificial Sequence: Synthetic oligonucleotide
ugcugcauauguggcuaaagc

SEQ ID NO: 2791 - RNA, 23 nt, Artificial Sequence
  Description of Artificial Sequence: Synthetic oligonucleotide
gcuuuagccacauaugcagcaag

SEQ ID NO: 2792 - RNA, 21 nt, Artificial Sequence
  Description of Artificial Sequence: Synthetic oligonucleotide
uugcugcauauguggcuaaag

SEQ ID NO: 2793 - RNA, 23 nt, Artificial Sequence
  Description of Artificial Sequence: Synthetic oligonucleotide
cuuuagccacauaugcagcaagu

SEQ ID NO: 2794 - RNA, 21 nt, Artificial Sequence
  Description of Artificial Sequence: Synthetic oligonucleotide
aaaugaugaagaaacuuuggc

SEQ ID NO: 2795 - RNA, 23 nt, Artificial Sequence
  Description of Artificial Sequence: Synthetic oligonucleotide
gccaaaguuucuucaucauuugc

SEQ ID NO: 2796 - RNA, 21 nt, Artificial Sequence
  Description of Artificial Sequence: Synthetic oligonucleotide
aaugaugaagaaacuuuggcu

SEQ ID NO: 2797 - RNA, 23 nt, Artificial Sequence
  Description of Artificial Sequence: Synthetic oligonucleotide
agccaaaguuucuucaucauuug

SEQ ID NO: 2798 - RNA, 21 nt, Artificial Sequence
  Description of Artificial Sequence: Synthetic oligonucleotide
gggcaaaugaugaagaaacuu

SEQ ID NO: 2799 - RNA, 23 nt, Artificial Sequence
  Description of Artificial Sequence: Synthetic oligonucleotide
aaguuucuucaucauuugcccca

SEQ ID NO: 2800 - RNA, 21 nt, Artificial Sequence
  Description of Artificial Sequence: Synthetic oligonucleotide
ggggcaaaugaugaagaaacu

SEQ ID NO: 2801 - RNA, 23 nt, Artificial Sequence
  Description of Artificial Sequence: Synthetic oligonucleotide
aguuucuucaucauuugccccag

SEQ ID NO: 2802 - RNA, 21 nt, Artificial Sequence
  Description of Artificial Sequence: Synthetic oligonucleotide
gagauacuaaaggaagaauuc

SEQ ID NO: 2803 - RNA, 23 nt, Artificial Sequence
  Description of Artificial Sequence: Synthetic oligonucleotide
gaauucuuccuuuaguaucucga

SEQ ID NO: 2804 - RNA, 21 nt, Artificial Sequence
  Description of Artificial Sequence: Synthetic oligonucleotide
agauacuaaaggaagaauucc

SEQ ID NO: 2805 - RNA, 23 nt, Artificial Sequence
  Description of Artificial Sequence: Synthetic oligonucleotide
ggaauucuuccuuuaguaucucg

SEQ ID NO: 2806 - RNA, 21 nt, Artificial Sequence
  Description of Artificial Sequence: Synthetic oligonucleotide
ccucgagauacuaaaggaaga

SEQ ID NO: 2807 - RNA, 23 nt, Artificial Sequence
  Description of Artificial Sequence: Synthetic oligonucleotide
ucuuccuuuaguaucucgaggac

SEQ ID NO: 2808 - RNA, 21 nt, Artificial Sequence
  Description of Artificial Sequence: Synthetic oligonucleotide
uccucgagauacuaaaggaag

SEQ ID NO: 2809 - RNA, 23 nt, Artificial Sequence
  Description of Artificial Sequence: Synthetic oligonucleotide
cuuccuuuaguaucucgaggaca

SEQ ID NO: 2810 - RNA, 21 nt, Artificial Sequence
  Description of Artificial Sequence: Synthetic oligonucleotide
acaacucaggaugaaaaauuu

SEQ ID NO: 2811 - RNA, 23 nt, Artificial Sequence
  Description of Artificial Sequence: Synthetic oligonucleotide
aaauuuuucauccugaguugugg

SEQ ID NO: 2812 - RNA, 21 nt, Artificial Sequence
  Description of Artificial Sequence: Synthetic oligonucleotide
caacucaggaugaaaaauuuu

SEQ ID NO: 2813 - RNA, 23 nt, Artificial Sequence
  Description of Artificial Sequence: Synthetic oligonucleotide
aaaauuuuucauccugaguugug

SEQ ID NO: 2814 - RNA, 21 nt, Artificial Sequence
  Description of Artificial Sequence: Synthetic oligonucleotide
cgccacaacucaggaugaaaa

SEQ ID NO: 2815 - RNA, 23 nt, Artificial Sequence
  Description of Artificial Sequence: Synthetic oligonucleotide
uuuucauccugaguuguggcggc

SEQ ID NO: 2816 - RNA, 21 nt, Artificial Sequence
  Description of Artificial Sequence: Synthetic oligonucleotide
ccgccacaacucaggaugaaa

SEQ ID NO: 2817 - RNA, 23 nt, Artificial Sequence
  Description of Artificial Sequence: Synthetic oligonucleotide
uuucauccugaguuguggcggca

SEQ ID NO: 2818 - RNA, 21 nt, Artificial Sequence
  Description of Artificial Sequence: Synthetic oligonucleotide
agggaagguggaagucuuccu

SEQ ID NO: 2819 - RNA, 23 nt, Artificial Sequence
  Description of Artificial Sequence: Synthetic oligonucleotide
aggaagacuuccaccuucccuuc

SEQ ID NO: 2820 - RNA, 21 nt, Artificial Sequence
  Description of Artificial Sequence: Synthetic oligonucleotide
gggaagguggaagucuuccug

SEQ ID NO: 2821 - RNA, 23 nt, Artificial Sequence
  Description of Artificial Sequence: Synthetic oligonucleotide
caggaagacuuccaccuucccuu

SEQ ID NO: 2822 - RNA, 21 nt, Artificial Sequence
  Description of Artificial Sequence: Synthetic oligonucleotide
uggaagggaagguggaagucu

SEQ ID NO: 2823 - RNA, 23 nt, Artificial Sequence
  Description of Artificial Sequence: Synthetic oligonucleotide
agacuuccaccuucccuuccaca

SEQ ID NO: 2824 - RNA, 21 nt, Artificial Sequence
  Description of Artificial Sequence: Synthetic oligonucleotide
guggaagggaagguggaaguc

SEQ ID NO: 2825 - RNA, 23 nt, Artificial Sequence
  Description of Artificial Sequence: Synthetic oligonucleotide
gacuuccaccuucccuuccacag

SEQ ID NO: 2826 - RNA, 21 nt, Artificial Sequence
  Description of Artificial Sequence: Synthetic oligonucleotide
ggcgagcuugccacugugaga

SEQ ID NO: 2827 - RNA, 23 nt, Artificial Sequence
  Description of Artificial Sequence: Synthetic oligonucleotide
ucucacaguggcaagcucgccgu

SEQ ID NO: 2828 - RNA, 21 nt, Artificial Sequence
  Description of Artificial Sequence: Synthetic oligonucleotide
gcgagcuugccacugugagag

SEQ ID NO: 2829 - RNA, 23 nt, Artificial Sequence
  Description of Artificial Sequence: Synthetic oligonucleotide
cucucacaguggcaagcucgccg

SEQ ID NO: 2830 - RNA, 21 nt, Artificial Sequence
  Description of Artificial Sequence: Synthetic oligonucleotide
ggacggcgagcuugccacugu

SEQ ID NO: 2831 - RNA, 23 nt, Artificial Sequence
  Description of Artificial Sequence: Synthetic oligonucleotide
acaguggcaagcucgccguccac

SEQ ID NO: 2832 - RNA, 21 nt, Artificial Sequence
  Description of Artificial Sequence: Synthetic oligonucleotide
uggacggcgagcuugccacug

SEQ ID NO: 2833 - RNA, 23 nt, Artificial Sequence
  Description of Artificial Sequence: Synthetic oligonucleotide
caguggcaagcucgccguccaca

SEQ ID NO: 2834 - RNA, 21 nt, Artificial Sequence
  Description of Artificial Sequence: Synthetic oligonucleotide
augugcguaacagauucaaac

SEQ ID NO: 2835 - RNA, 23 nt, Artificial Sequence
  Description of Artificial Sequence: Synthetic oligonucleotide
guuugaaucuguuacgcacauca

SEQ ID NO: 2836 - RNA, 21 nt, Artificial Sequence
  Description of Artificial Sequence: Synthetic oligonucleotide
ugugcguaacagauucaaacu

SEQ ID NO: 2837 - RNA, 23 nt, Artificial Sequence
  Description of Artificial Sequence: Synthetic oligonucleotide
aguuugaaucuguuacgcacauc

SEQ ID NO: 2838 - RNA, 21 nt, Artificial Sequence
  Description of Artificial Sequence: Synthetic oligonucleotide
gaugaugugcguaacagauuc

SEQ ID NO: 2839 - RNA, 23 nt, Artificial Sequence
  Description of Artificial Sequence: Synthetic oligonucleotide
gaaucuguuacgcacaucaucca

SEQ ID NO: 2840 - RNA, 21 nt, Artificial Sequence
  Description of Artificial Sequence: Synthetic oligonucleotide
ggaugaugugcguaacagauu

SEQ ID NO: 2841 - RNA, 23 nt, Artificial Sequence
  Description of Artificial Sequence: Synthetic oligonucleotide
aaucuguuacgcacaucauccag

SEQ ID NO: 2842 - RNA, 21 nt, Artificial Sequence
  Description of Artificial Sequence: Synthetic oligonucleotide
gggucagcaugccaauaugug

SEQ ID NO: 2843 - RNA, 23 nt, Artificial Sequence
  Description of Artificial Sequence: Synthetic oligonucleotide
cacauauuggcaugcugacccuc

SEQ ID NO: 2844 - RNA, 21 nt, Artificial Sequence
  Description of Artificial Sequence: Synthetic oligonucleotide
ggucagcaugccaauaugugu

SEQ ID NO: 2845 - RNA, 23 nt, Artificial Sequence
  Description of Artificial Sequence: Synthetic oligonucleotide
acacauauuggcaugcugacccu

SEQ ID NO: 2846 - RNA, 21 nt, Artificial Sequence
  Description of Artificial Sequence: Synthetic oligonucleotide
cagagggucagcaugccaaua

SEQ ID NO: 2847 - RNA, 23 nt, Artificial Sequence
  Description of Artificial Sequence: Synthetic oligonucleotide
uauuggcaugcugacccucuguc

SEQ ID NO: 2848 - RNA, 21 nt, Artificial Sequence
  Description of Artificial Sequence: Synthetic oligonucleotide
acagagggucagcaugccaau

SEQ ID NO: 2849 - RNA, 23 nt, Artificial Sequence
  Description of Artificial Sequence: Synthetic oligonucleotide
auuggcaugcugacccucugucc

SEQ ID NO: 2850 - RNA, 21 nt, Artificial Sequence
  Description of Artificial Sequence: Synthetic oligonucleotide
gcuugaaugggaucuuggugu

SEQ ID NO: 2851 - RNA, 23 nt, Artificial Sequence
  Description of Artificial Sequence: Synthetic oligonucleotide
acaccaagaucccauucaagcca

SEQ ID NO: 2852 - RNA, 21 nt, Artificial Sequence
  Description of Artificial Sequence: Synthetic oligonucleotide
cuugaaugggaucuugguguc

SEQ ID NO: 2853 - RNA, 23 nt, Artificial Sequence
  Description of Artificial Sequence: Synthetic oligonucleotide
gacaccaagaucccauucaagcc

SEQ ID NO: 2854 - RNA, 21 nt, Artificial Sequence
  Description of Artificial Sequence: Synthetic oligonucleotide
cauggcuugaaugggaucuug

SEQ ID NO: 2855 - RNA, 23 nt, Artificial Sequence
  Description of Artificial Sequence: Synthetic oligonucleotide
caagaucccauucaagccauguu

SEQ ID NO: 2856 - RNA, 21 nt, Artificial Sequence
  Description of Artificial Sequence: Synthetic oligonucleotide
acauggcuugaaugggaucuu

SEQ ID NO: 2857 - RNA, 23 nt, Artificial Sequence
  Description of Artificial Sequence: Synthetic oligonucleotide
aagaucccauucaagccauguuu

SEQ ID NO: 2858 - RNA, 21 nt, Artificial Sequence
  Description of Artificial Sequence: Synthetic oligonucleotide
ucaaauggcugagaagacuga

SEQ ID NO: 2859 - RNA, 23 nt, Artificial Sequence
  Description of Artificial Sequence: Synthetic oligonucleotide
ucagucuucucagccauuugaua

SEQ ID NO: 2860 - RNA, 21 nt, Artificial Sequence
  Description of Artificial Sequence: Synthetic oligonucleotide
caaauggcugagaagacugac

SEQ ID NO: 2861 - RNA, 23 nt, Artificial Sequence
  Description of Artificial Sequence: Synthetic oligonucleotide
gucagucuucucagccauuugau

SEQ ID NO: 2862 - RNA, 21 nt, Artificial Sequence
  Description of Artificial Sequence: Synthetic oligonucleotide
gauaucaaauggcugagaaga

SEQ ID NO: 2863 - RNA, 23 nt, Artificial Sequence
  Description of Artificial Sequence: Synthetic oligonucleotide
ucuucucagccauuugauaucuu

SEQ ID NO: 2864 - RNA, 21 nt, Artificial Sequence
  Description of Artificial Sequence: Synthetic oligonucleotide
agauaucaaauggcugagaag

SEQ ID NO: 2865 - RNA, 23 nt, Artificial Sequence
  Description of Artificial Sequence: Synthetic oligonucleotide
cuucucagccauuugauaucuuc

SEQ ID NO: 2866 - RNA, 21 nt, Artificial Sequence
  Description of Artificial Sequence: Synthetic oligonucleotide
gaaagucaucgacaagacauu

SEQ ID NO: 2867 - RNA, 23 nt, Artificial Sequence
  Description of Artificial Sequence: Synthetic oligonucleotide
aaugucuugucgaugacuuucac

SEQ ID NO: 2868 - RNA, 21 nt, Artificial Sequence
  Description of Artificial Sequence: Synthetic oligonucleotide
aaagucaucgacaagacauug

SEQ ID NO: 2869 - RNA, 23 nt, Artificial Sequence
  Description of Artificial Sequence: Synthetic oligonucleotide
caaugucuugucgaugacuuuca

SEQ ID NO: 2870 - RNA, 21 nt, Artificial Sequence
  Description of Artificial Sequence: Synthetic oligonucleotide
augugaaagucaucgacaaga

SEQ ID NO: 2871 - RNA, 23 nt, Artificial Sequence
  Description of Artificial Sequence: Synthetic oligonucleotide
ucuugucgaugacuuucacauuc

SEQ ID NO: 2872 - RNA, 21 nt, Artificial Sequence
  Description of Artificial Sequence: Synthetic oligonucleotide
aaugugaaagucaucgacaag

SEQ ID NO: 2873 - RNA, 23 nt, Artificial Sequence
  Description of Artificial Sequence: Synthetic oligonucleotide
cuugucgaugacuuucacauucu

SEQ ID NO: 2874 - RNA, 21 nt, Artificial Sequence
  Description of Artificial Sequence: Synthetic oligonucleotide
ggcuaauuuguaucaaugauu

SEQ ID NO: 2875 - RNA, 23 nt, Artificial Sequence
  Description of Artificial Sequence: Synthetic oligonucleotide
aaucauugauacaaauuagccgg

SEQ ID NO: 2876 - RNA, 21 nt, Artificial Sequence
  Description of Artificial Sequence: Synthetic oligonucleotide
gcuaauuuguaucaaugauua

SEQ ID NO: 2877 - RNA, 23 nt, Artificial Sequence
  Description of Artificial Sequence: Synthetic oligonucleotide
uaaucauugauacaaauuagccg

SEQ ID NO: 2878 - RNA, 21 nt, Artificial Sequence
  Description of Artificial Sequence: Synthetic oligonucleotide
ccccggcuaauuuguaucaau

SEQ ID NO: 2879 - RNA, 23 nt, Artificial Sequence
  Description of Artificial Sequence: Synthetic oligonucleotide
auugauacaaauuagccggggga

SEQ ID NO: 2880 - RNA, 21 nt, Artificial Sequence
  Description of Artificial Sequence: Synthetic oligonucleotide
cccccggcuaauuuguaucaa

SEQ ID NO: 2881 - RNA, 23 nt, Artificial Sequence
  Description of Artificial Sequence: Synthetic oligonucleotide
uugauacaaauuagccgggggag

SEQ ID NO: 2882 - RNA, 21 nt, Artificial Sequence
  Description of Artificial Sequence: Synthetic oligonucleotide
ugucgacuucuguuuuaggac

SEQ ID NO: 2883 - RNA, 23 nt, Artificial Sequence
  Description of Artificial Sequence: Synthetic oligonucleotide
guccuaaaacagaagucgacaga

SEQ ID NO: 2884 - RNA, 21 nt, Artificial Sequence
  Description of Artificial Sequence: Synthetic oligonucleotide
gucgacuucuguuuuaggaca

SEQ ID NO: 2885 - RNA, 23 nt, Artificial Sequence
  Description of Artificial Sequence: Synthetic oligonucleotide
uguccuaaaacagaagucgacag

SEQ ID NO: 2886 - RNA, 21 nt, Artificial Sequence
  Description of Artificial Sequence: Synthetic oligonucleotide
gaucugucgacuucuguuuua

SEQ ID NO: 2887 - RNA, 23 nt, Artificial Sequence
  Description of Artificial Sequence: Synthetic oligonucleotide
uaaaacagaagucgacagaucug

SEQ ID NO: 2888 - RNA, 21 nt, Artificial Sequence
  Description of Artificial Sequence: Synthetic oligonucleotide
agaucugucgacuucuguuuu

SEQ ID NO: 2889 - RNA, 23 nt, Artificial Sequence
  Description of Artificial Sequence: Synthetic oligonucleotide
aaaacagaagucgacagaucugu

SEQ ID NO: 2890 - RNA, 21 nt, Artificial Sequence
  Description of Artificial Sequence: Synthetic oligonucleotide
ccgagaagucaccaagaagcu

SEQ ID NO: 2891 - RNA, 23 nt, Artificial Sequence
  Description of Artificial Sequence: Synthetic oligonucleotide
agcuucuuggugacuucucgguc

SEQ ID NO: 2892 - RNA, 21 nt, Artificial Sequence
  Description of Artificial Sequence: Synthetic oligonucleotide
cgagaagucaccaagaagcua

SEQ ID NO: 2893 - RNA, 23 nt, Artificial Sequence
  Description of Artificial Sequence: Synthetic oligonucleotide
uagcuucuuggugacuucucggu

SEQ ID NO: 2894 - RNA, 21 nt, Artificial Sequence
  Description of Artificial Sequence: Synthetic oligonucleotide
aggaccgagaagucaccaaga

SEQ ID NO: 2895 - RNA, 23 nt, Artificial Sequence
  Description of Artificial Sequence: Synthetic oligonucleotide
ucuuggugacuucucgguccuug

SEQ ID NO: 2896 - RNA, 21 nt, Artificial Sequence
  Description of Artificial Sequence: Synthetic oligonucleotide
aaggaccgagaagucaccaag

SEQ ID NO: 2897 - RNA, 23 nt, Artificial Sequence
  Description of Artificial Sequence: Synthetic oligonucleotide
cuuggugacuucucgguccuugu

SEQ ID NO: 2898 - RNA, 21 nt, Artificial Sequence
  Description of Artificial Sequence: Synthetic oligonucleotide
aaacauggcuugaaugggauc

SEQ ID NO: 2899 - RNA, 23 nt, Artificial Sequence
  Description of Artificial Sequence: Synthetic oligonucleotide
gaucccauucaagccauguuuaa

SEQ ID NO: 2900 - RNA, 21 nt, Artificial Sequence
  Description of Artificial Sequence: Synthetic oligonucleotide
aacauggcuugaaugggaucu

SEQ ID NO: 2901 - RNA, 23 nt, Artificial Sequence
  Description of Artificial Sequence: Synthetic oligonucleotide
agaucccauucaagccauguuua

SEQ ID NO: 2902 - RNA, 21 nt, Artificial Sequence
  Description of Artificial Sequence: Synthetic oligonucleotide
uguuaaacauggcuugaaugg

SEQ ID NO: 2903 - RNA, 23 nt, Artificial Sequence
  Description of Artificial Sequence: Synthetic oligonucleotide
ccauucaagccauguuuaacagc

SEQ ID NO: 2904 - RNA, 21 nt, Artificial Sequence
  Description of Artificial Sequence: Synthetic oligonucleotide
cuguuaaacauggcuugaaug

SEQ ID NO: 2905 - RNA, 23 nt, Artificial Sequence
  Description of Artificial Sequence: Synthetic oligonucleotide
cauucaagccauguuuaacagcc

SEQ ID NO: 2906 - RNA, 21 nt, Artificial Sequence
  Description of Artificial Sequence: Synthetic oligonucleotide
gacuugcugcauauguggcua

SEQ ID NO: 2907 - RNA, 23 nt, Artificial Sequence
  Description of Artificial Sequence: Synthetic oligonucleotide
uagccacauaugcagcaagucca

SEQ ID NO: 2908 - RNA, 21 nt, Artificial Sequence
  Description of Artificial Sequence: Synthetic oligonucleotide
acuugcugcauauguggcuaa

SEQ ID NO: 2909 - RNA, 23 nt, Artificial Sequence
  Description of Artificial Sequence: Synthetic oligonucleotide
uuagccacauaugcagcaagucc

SEQ ID NO: 2910 - RNA, 21 nt, Artificial Sequence
  Description of Artificial Sequence: Synthetic oligonucleotide
aguggacuugcugcauaugug

SEQ ID NO: 2911 - RNA, 23 nt, Artificial Sequence
  Description of Artificial Sequence: Synthetic oligonucleotide
cacauaugcagcaaguccacugu

SEQ ID NO: 2912 - RNA, 21 nt, Artificial Sequence
  Description of Artificial Sequence: Synthetic oligonucleotide
caguggacuugcugcauaugu

SEQ ID NO: 2913 - RNA, 23 nt, Artificial Sequence
  Description of Artificial Sequence: Synthetic oligonucleotide
acauaugcagcaaguccacuguc

SEQ ID NO: 2914 - RNA, 21 nt, Artificial Sequence
  Description of Artificial Sequence: Synthetic oligonucleotide
uaaaucaguacuuccaaaguc

SEQ ID NO: 2915 - RNA, 23 nt, Artificial Sequence
  Description of Artificial Sequence: Synthetic oligonucleotide
gacuuuggaaguacugauuuagc

SEQ ID NO: 2916 - RNA, 21 nt, Artificial Sequence
  Description of Artificial Sequence: Synthetic oligonucleotide
aaaucaguacuuccaaagucu

SEQ ID NO: 2917 - RNA, 23 nt, Artificial Sequence
  Description of Artificial Sequence: Synthetic oligonucleotide
agacuuuggaaguacugauuuag

SEQ ID NO: 2918 - RNA, 21 nt, Artificial Sequence
  Description of Artificial Sequence: Synthetic oligonucleotide
augcuaaaucaguacuuccaa

SEQ ID NO: 2919 - RNA, 23 nt, Artificial Sequence
  Description of Artificial Sequence: Synthetic oligonucleotide
uuggaaguacugauuuagcaugu

SEQ ID NO: 2920 - RNA, 21 nt, Artificial Sequence
  Description of Artificial Sequence: Synthetic oligonucleotide
caugcuaaaucaguacuucca

SEQ ID NO: 2921 - RNA, 23 nt, Artificial Sequence
  Description of Artificial Sequence: Synthetic oligonucleotide
uggaaguacugauuuagcauguu

SEQ ID NO: 2922 - RNA, 21 nt, Artificial Sequence
  Description of Artificial Sequence: Synthetic oligonucleotide
uccucaauugaagaaguggcg

SEQ ID NO: 2923 - RNA, 23 nt, Artificial Sequence
  Description of Artificial Sequence: Synthetic oligonucleotide
cgccacuucuucaauugaggagg

SEQ ID NO: 2924 - RNA, 21 nt, Artificial Sequence
  Description of Artificial Sequence: Synthetic oligonucleotide
ccucaauugaagaaguggcgg

SEQ ID NO: 2925 - RNA, 23 nt, Artificial Sequence
  Description of Artificial Sequence: Synthetic oligonucleotide
ccgccacuucuucaauugaggag

SEQ ID NO: 2926 - RNA, 21 nt, Artificial Sequence
  Description of Artificial Sequence: Synthetic oligonucleotide
caccuccucaauugaagaagu

SEQ ID NO: 2927 - RNA, 23 nt, Artificial Sequence
  Description of Artificial Sequence: Synthetic oligonucleotide
acuucuucaauugaggagguggc

SEQ ID NO: 2928 - RNA, 21 nt, Artificial Sequence
  Description of Artificial Sequence: Synthetic oligonucleotide
ccaccuccucaauugaagaag

SEQ ID NO: 2929 - RNA, 23 nt, Artificial Sequence
  Description of Artificial Sequence: Synthetic oligonucleotide
cuucuucaauugaggagguggcc

SEQ ID NO: 2930 - RNA, 21 nt, Artificial Sequence
  Description of Artificial Sequence: Synthetic oligonucleotide
caagauguccucgagauacua

SEQ ID NO: 2931 - RNA, 23 nt, Artificial Sequence
  Description of Artificial Sequence: Synthetic oligonucleotide
uaguaucucgaggacaucuugaa

SEQ ID NO: 2932 - RNA, 21 nt, Artificial Sequence
  Description of Artificial Sequence: Synthetic oligonucleotide
aagauguccucgagauacuaa

SEQ ID NO: 2933 - RNA, 23 nt, Artificial Sequence
  Description of Artificial Sequence: Synthetic oligonucleotide
uuaguaucucgaggacaucuuga

SEQ ID NO: 2934 - RNA, 21 nt, Artificial Sequence
  Description of Artificial Sequence: Synthetic oligonucleotide
uguucaagauguccucgagau

SEQ ID NO: 2935 - RNA, 23 nt, Artificial Sequence
  Description of Artificial Sequence: Synthetic oligonucleotide
aucucgaggacaucuugaacacc

SEQ ID NO: 2936 - RNA, 21 nt, Artificial Sequence
  Description of Artificial Sequence: Synthetic oligonucleotide
guguucaagauguccucgaga

SEQ ID NO: 2937 - RNA, 23 nt, Artificial Sequence
  Description of Artificial Sequence: Synthetic oligonucleotide
ucucgaggacaucuugaacaccu

SEQ ID NO: 2938 - RNA, 21 nt, Artificial Sequence
  Description of Artificial Sequence: Synthetic oligonucleotide
acaugcuaaaucaguacuucc

SEQ ID NO: 2939 - RNA, 23 nt, Artificial Sequence
  Description of Artificial Sequence: Synthetic oligonucleotide
ggaaguacugauuuagcauguug

SEQ ID NO: 2940 - RNA, 21 nt, Artificial Sequence
  Description of Artificial Sequence: Synthetic oligonucleotide
caugcuaaaucaguacuucca

SEQ ID NO: 2941 - RNA, 23 nt, Artificial Sequence
  Description of Artificial Sequence: Synthetic oligonucleotide
uggaaguacugauuuagcauguu

SEQ ID NO: 2942 - RNA, 21 nt, Artificial Sequence
  Description of Artificial Sequence: Synthetic oligonucleotide
aacaacaugcuaaaucaguac

SEQ ID NO: 2943 - RNA, 23 nt, Artificial Sequence
  Description of Artificial Sequence: Synthetic oligonucleotide
guacugauuuagcauguuguuca

SEQ ID NO: 2944 - RNA, 21 nt, Artificial Sequence
  Description of Artificial Sequence: Synthetic oligonucleotide
gaacaacaugcuaaaucagua

SEQ ID NO: 2945 - RNA, 23 nt, Artificial Sequence
  Description of Artificial Sequence: Synthetic oligonucleotide
uacugauuuagcauguuguucau

SEQ ID NO: 2946 - RNA, 21 nt, Artificial Sequence
  Description of Artificial Sequence: Synthetic oligonucleotide
gaaaggcacugauguucugaa

SEQ ID NO: 2947 - RNA, 23 nt, Artificial Sequence
  Description of Artificial Sequence: Synthetic oligonucleotide
uucagaacaucagugccuuuccg

SEQ ID NO: 2948 - RNA, 21 nt, Artificial Sequence
  Description of Artificial Sequence: Synthetic oligonucleotide
aaaggcacugauguucugaaa

SEQ ID NO: 2949 - RNA, 23 nt, Artificial Sequence
  Description of Artificial Sequence: Synthetic oligonucleotide
uuucagaacaucagugccuuucc

SEQ ID NO: 2950 - RNA, 21 nt, Artificial Sequence
  Description of Artificial Sequence: Synthetic oligonucleotide
ugcggaaaggcacugauguuc

SEQ ID NO: 2951 - RNA, 23 nt, Artificial Sequence
  Description of Artificial Sequence: Synthetic oligonucleotide
gaacaucagugccuuuccgcaca

SEQ ID NO: 2952 - RNA, 21 nt, Artificial Sequence
  Description of Artificial Sequence: Synthetic oligonucleotide
gugcggaaaggcacugauguu

SEQ ID NO: 2953 - RNA, 23 nt, Artificial Sequence
  Description of Artificial Sequence: Synthetic oligonucleotide
aacaucagugccuuuccgcacac

SEQ ID NO: 2954 - RNA, 21 nt, Artificial Sequence
  Description of Artificial Sequence: Synthetic oligonucleotide
gucagcaugccaauaugugug

SEQ ID NO: 2955 - RNA, 23 nt, Artificial Sequence
  Description of Artificial Sequence: Synthetic oligonucleotide
cacacauauuggcaugcugaccc

SEQ ID NO: 2956 - RNA, 21 nt, Artificial Sequence
  Description of Artificial Sequence: Synthetic oligonucleotide
ucagcaugccaauaugugugg

SEQ ID NO: 2957 - RNA, 23 nt, Artificial Sequence
  Description of Artificial Sequence: Synthetic oligonucleotide
ccacacauauuggcaugcugacc

SEQ ID NO: 2958 - RNA, 21 nt, Artificial Sequence
  Description of Artificial Sequence: Synthetic oligonucleotide
gagggucagcaugccaauaug

SEQ ID NO: 2959 - RNA, 23 nt, Artificial Sequence
  Description of Artificial Sequence: Synthetic oligonucleotide
cauauuggcaugcugacccucug

SEQ ID NO: 2960 - RNA, 21 nt, Artificial Sequence
  Description of Artificial Sequence: Synthetic oligonucleotide
agagggucagcaugccaauau

SEQ ID NO: 2961 - RNA, 23 nt, Artificial Sequence
  Description of Artificial Sequence: Synthetic oligonucleotide
auauuggcaugcugacccucugu

SEQ ID NO: 2962 - RNA, 21 nt, Artificial Sequence
  Description of Artificial Sequence: Synthetic oligonucleotide
gaugcuccggaauguugcuga

SEQ ID NO: 2963 - RNA, 23 nt, Artificial Sequence
  Description of Artificial Sequence: Synthetic oligonucleotide
ucagcaacauuccggagcauccu

SEQ ID NO: 2964 - RNA, 21 nt, Artificial Sequence
  Description of Artificial Sequence: Synthetic oligonucleotide
augcuccggaauguugcugaa

SEQ ID NO: 2965 - RNA, 23 nt, Artificial Sequence
  Description of Artificial Sequence: Synthetic oligonucleotide
uucagcaacauuccggagcaucc

SEQ ID NO: 2966 - RNA, 21 nt, Artificial Sequence
  Description of Artificial Sequence: Synthetic oligonucleotide
caaggaugcuccggaauguug

SEQ ID NO: 2967 - RNA, 23 nt, Artificial Sequence
  Description of Artificial Sequence: Synthetic oligonucleotide
caacauuccggagcauccuugga

SEQ ID NO: 2968 - RNA, 21 nt, Artificial Sequence
  Description of Artificial Sequence: Synthetic oligonucleotide
ccaaggaugcuccggaauguu

SEQ ID NO: 2969 - RNA, 23 nt, Artificial Sequence
  Description of Artificial Sequence: Synthetic oligonucleotide
aacauuccggagcauccuuggau

SEQ ID NO: 2970 - RNA, 21 nt, Artificial Sequence
  Description of Artificial Sequence: Synthetic oligonucleotide
gcguaacagauucaaacugcc

SEQ ID NO: 2971 - RNA, 23 nt, Artificial Sequence
  Description of Artificial Sequence: Synthetic oligonucleotide
ggcaguuugaaucuguuacgcac

SEQ ID NO: 2972 - RNA, 21 nt, Artificial Sequence
  Description of Artificial Sequence: Synthetic oligonucleotide
cguaacagauucaaacugccg

SEQ ID NO: 2973 - RNA, 23 nt, Artificial Sequence
  Description of Artificial Sequence: Synthetic oligonucleotide
cggcaguuugaaucuguuacgca

SEQ ID NO: 2974 - RNA, 21 nt, Artificial Sequence
  Description of Artificial Sequence: Synthetic oligonucleotide
augugcguaacagauucaaac

SEQ ID NO: 2975 - RNA, 23 nt, Artificial Sequence
  Description of Artificial Sequence: Synthetic oligonucleotide
guuugaaucuguuacgcacauca

SEQ ID NO: 2976 - RNA, 21 nt, Artificial Sequence
  Description of Artificial Sequence: Synthetic oligonucleotide
gaugugcguaacagauucaaa

SEQ ID NO: 2977 - RNA, 23 nt, Artificial Sequence
  Description of Artificial Sequence: Synthetic oligonucleotide
uuugaaucuguuacgcacaucau

SEQ ID NO: 2978 - RNA, 21 nt, Artificial Sequence
  Description of Artificial Sequence: Synthetic oligonucleotide
agagaagaugggcuacaaggc

SEQ ID NO: 2979 - RNA, 23 nt, Artificial Sequence
  Description of Artificial Sequence: Synthetic oligonucleotide
gccuuguagcccaucuucucugc

SEQ ID NO: 2980 - RNA, 21 nt, Artificial Sequence
  Description of Artificial Sequence: Synthetic oligonucleotide
gagaagaugggcuacaaggcc

SEQ ID NO: 2981 - RNA, 23 nt, Artificial Sequence
  Description of Artificial Sequence: Synthetic oligonucleotide
ggccuuguagcccaucuucucug

SEQ ID NO: 2982 - RNA, 21 nt, Artificial Sequence
  Description of Artificial Sequence: Synthetic oligonucleotide
aggcagagaagaugggcuaca

SEQ ID NO: 2983 - RNA, 23 nt, Artificial Sequence
  Description of Artificial Sequence: Synthetic oligonucleotide
uguagcccaucuucucugccugc

SEQ ID NO: 2984 - RNA, 21 nt, Artificial Sequence
  Description of Artificial Sequence: Synthetic oligonucleotide
caggcagagaagaugggcuac

SEQ ID NO: 2985 - RNA, 23 nt, Artificial Sequence
  Description of Artificial Sequence: Synthetic oligonucleotide
guagcccaucuucucugccugcc

We claim:

1. A double stranded RNAi agent capable of inhibiting expression of HAO1 in a cell, wherein said double stranded RNAi agent comprises a sense strand and an antisense strand forming a double-stranded region, wherein the sense strand nucleotide sequence consists of SEQ ID NO:589 and the antisense strand nucleotide sequence consists of SEQ ID NO:706;

wherein substantially all of the nucleotides of said sense strand and substantially all of the nucleotides of said antisense strand are modified nucleotides, and wherein said sense strand is conjugated to a ligand attached at the 3'-terminus.

2. The double stranded RNAi agent of claim 1, wherein all of the nucleotides of said sense strand and all of the nucleotides of said antisense strand are modified nucleotides.

3. The double stranded RNAi agent of claim 1, wherein at least one of said modified nucleotides is selected from the group consisting of a 3'-terminal deoxy-thymine (dT) nucleotide, a 2'-O-methyl modified nucleotide, a 2'-fluoro modified nucleotide, a 2'-deoxy-modified nucleotide, a locked nucleotide, an abasic nucleotide, a 2'-amino-modified nucleotide, a 2'-alkyl-modified nucleotide, a morpholino nucleotide, a phosphoramidate, a non-natural base comprising nucleotide, a nucleotide comprising a 5'-phosphorothioate group, a nucleotide comprising a 5' phosphate or 5' phosphate mimic, and a terminal nucleotide linked to a cholesteryl derivative or a dodecanoic acid bisdecylamide group.

4. The double stranded RNAi agent of claim 1, wherein the ligand is one or more GalNAc derivatives attached through a bivalent or trivalent branched linker.

5. The double stranded RNAi agent claim 1, wherein the ligand is

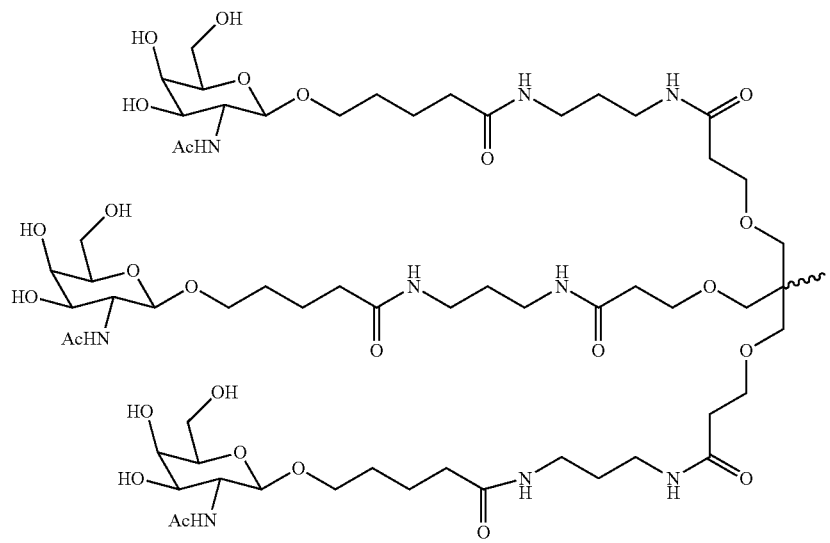

6. The double stranded RNAi agent of claim 1, wherein the ligand is attached to the 3' end of the sense strand.

7. The double stranded RNAi agent of claim 6, wherein the RNAi agent is conjugated to the ligand as shown in the following schematic

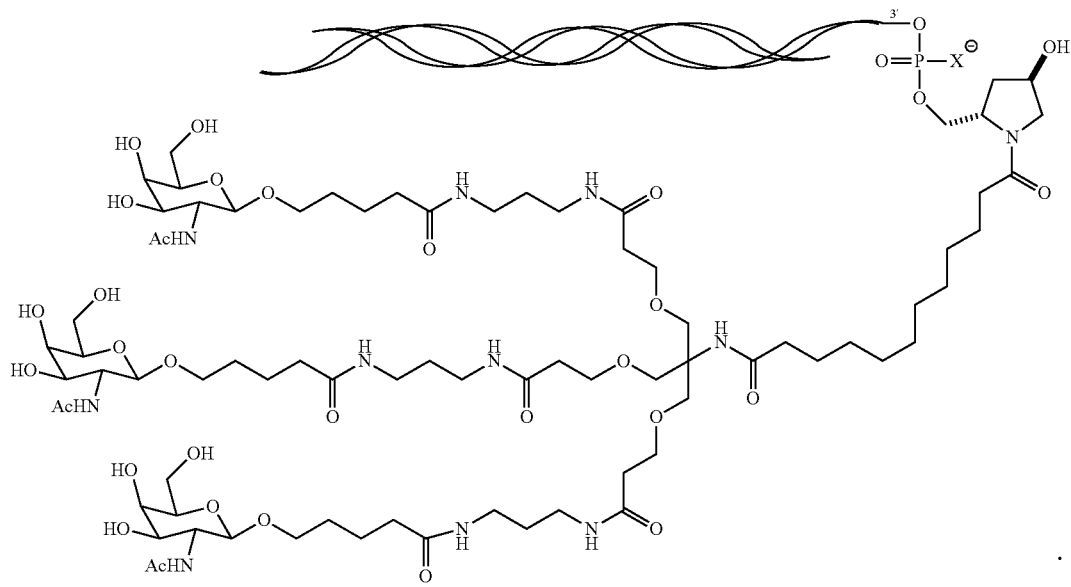

wherein X is O or S.

8. The double stranded RNAi agent of claim 1, wherein said agent further comprises at least one phosphorothioate or methylphosphonate internucleotide linkage.

9. The double stranded RNAi agent of claim 8, wherein the phosphorothioate or methylphosphonate internucleotide linkage is at the 3'-terminus of one strand.

10. The double stranded RNAi agent of claim 8, wherein the phosphorothioate or methylphosphonate internucleotide linkage is at the 5'-terminus of one strand.

11. The double stranded RNAi agent of claim 8, wherein the phosphorothioate or methylphosphonate internucleotide linkage is at the both the 5'- and 3'-terminus of one strand.

12. The double stranded RNAi agent of claim 1, wherein the base pair at the 1 position of the 5'-end of the antisense strand of the duplex is an AU base pair.

13. The double stranded RNAi agent of claim 1, wherein the sense strand nucleotide sequence comprises SEQ ID NO:589 and the antisense strand nucleotide sequence comprises SEQ ID NO:706.

14. The double stranded RNAi agent of claim 1, wherein the sense strand nucleotide sequence consists of SEQ ID NO:589 and the antisense strand nucleotide sequence consists of SEQ ID NO:706.

15. A vector containing the double stranded RNAi agent of claim 1.

16. A cell containing the double stranded RNAi agent of claim 1.

17. A pharmaceutical composition comprising the double stranded RNAi agent of claim 1.

18. A method of inhibiting HAO1 expression in a cell, the method comprising:
(a) contacting the cell with the double stranded RNAi agent of claim 1; and
(b) maintaining the cell produced in step (a) for a time sufficient to obtain degradation of the mRNA transcript of a HAO1 gene, thereby inhibiting expression of the HAO1 gene in the cell.

19. The double stranded RNAi agent of claim 1, wherein the sense strand consists of SEQ ID NO:213 (gsascuuuCfaUfCfCfuggaaauauaL96) and the antisense strand consists of SEQ ID NO:330 (usAfsuauUfuCfCfaggaUfgAfaaguc-scsa) and each abbreviation represents a nucleotide monomer as follows:

| Abbreviation | Nucleotide(s) |
|---|---|
| Af | 2'-fluoroadenosine-3'-phosphate |
| Afs | 2'-fluoroadenosine-3'-phosphorothioate |
| Cf | 2'-fluorocytidine-3'-phosphate |
| U | Uridine-3'-phosphate |
| Uf | 2'-fluorouridine-3'-phosphate |
| a | 2'-O-methyladenosine-3'-phosphate |
| as | 2'-O-methyladenosine-3'-phosphorothioate |
| c | 2'-O-methylcytidine-3'-phosphate |
| cs | 2'-O-methylcytidine-3'-phosphorothioate |
| g | 2'-O-methylguanosine-3'-phosphate |
| gs | 2'-O-methylguanosine-3'-phosphorothioate |
| u | 2'-O-methyluridine-3'-phosphate |
| us | 2'-O-methyluridine-3'-phosphorothioate |
| s | phosphorothioate linkage |
| L96 | N-[tris(GalNAc-alkyl)-amidodecanoyl)]-4-hydroxyprolinol Hyp-(GalNAc-alkyl)3. |

* * * * *